United States Patent 11,692,002 (RNA SEQUENCE ADAPTATION) - sequence listing, part 6

SEQ ID NO: 17643 - RNA, 1410 nt, Artificial Sequence
  derived and/or modified CDS sequence (AUadapt) from InfluenzaA__ABG80230__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaacauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcgaguccgcccagcacguggaggagugcucgugcuacccccgguaccccggggugcgcugcgucugccgggacaacuggaagggcuccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaaggggugggccuucgacgacggcaacgacguguggaugggccgcaccaucucggagaagcugcgguccggguacgagaccuucaaggucaucgagggcuggucgaagcccaacuccaagcuccagaccaaccgccaggugaucguggagcgggggaaccgcagcggcuacuccgggaucuucucggucgagggcaaguccugcaucaaccggugcuucuacguggagcugauccgcggccggaaggaggagaccgaggugugguggaccagcaacucgaucgucguguucugcgggaccuccggcacguacgggaccggcagcuggccggacggggccgacaucaaccugaugcccaucuga

SEQ ID NO: 17644 - RNA, 1410 nt, Artificial Sequence; identical to SEQ ID NO: 16993
  derived and/or modified CDS sequence (AUadapt) from InfluenzaA__ABG80241__NA

SEQ ID NO: 17645 - RNA, 1410 nt, Artificial Sequence; identical to SEQ ID NO: 16993
  derived and/or modified CDS sequence (AUadapt) from InfluenzaA__ABG80252__NA

SEQ ID NO: 17646 - RNA, 1410 nt, Artificial Sequence; identical to SEQ ID NO: 17577
  derived and/or modified CDS sequence (AUadapt) from InfluenzaA__ABG80263__NA

SEQ ID NO: 17647 - RNA, 1410 nt, Artificial Sequence; identical to SEQ ID NO: 17138
  derived and/or modified CDS sequence (AUadapt) from InfluenzaA__ABG80274__NA

SEQ ID NO: 17648 - RNA, 1410 nt, Artificial Sequence; identical to SEQ ID NO: 16729
  derived and/or modified CDS sequence (AUadapt) from InfluenzaA__ABG80285__NA

SEQ ID NO: 17649 - RNA, 1410 nt, Artificial Sequence; identical to SEQ ID NO: 16729
  derived and/or modified CDS sequence (AUadapt) from InfluenzaA__ABG80296__NA

SEQ ID NO: 17650 - RNA, 1410 nt, Artificial Sequence; identical to SEQ ID NO: 16729
  derived and/or modified CDS sequence (AUadapt) from InfluenzaA__ABG80307__NA

SEQ ID NO: 17651 - RNA, 1410 nt, Artificial Sequence; identical to SEQ ID NO: 17116
  derived and/or modified CDS sequence (AUadapt) from InfluenzaA__ABG80318__NA

SEQ ID NO: 17652 - RNA, 1410 nt, Artificial Sequence; identical to SEQ ID NO: 16729
  derived and/or modified CDS sequence (AUadapt) from InfluenzaA__ABG80329__NA

SEQ ID NO: 17653 - RNA, 1410 nt, Artificial Sequence; identical to SEQ ID NO: 16729
  derived and/or modified CDS sequence (AUadapt) from InfluenzaA__ABG80340__NA

SEQ ID NO: 17654 - RNA, 1410 nt, Artificial Sequence; identical to SEQ ID NO: 17587
  derived and/or modified CDS sequence (AUadapt) from InfluenzaA__ABG80351__NA

SEQ ID NO: 17655 - RNA, 1410 nt, Artificial Sequence
  derived and/or modified CDS sequence (AUadapt) from InfluenzaA__ABG80373__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggaccacucgaucgucuccagcuacgugugcuccggccucgugggggacacgccccgcaagaacgacucguccucguccagcuacugccggaaccccaacaacgagaagggcucccacggggucaagggcugggccuucgacgacgggaacgacguguggaugggccgcaccaucucggaggagcugcgguccggcuacgagaccuucaaggucaucgggggcuggagcaagccgaacuccaagcugcagaucaaccgccaggugaucguggaccgggggaaccgcucgggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 17656 - RNA, 1410 nt, Artificial Sequence; identical to SEQ ID NO: 17655
  derived and/or modified CDS sequence (AUadapt) from InfluenzaA__ABG80384__NA

SEQ ID NO: 17657 - RNA, 1410 nt, Artificial Sequence
  derived and/or modified CDS sequence (AUadapt) from InfluenzaA__ABG80395__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccaagcgggcggacaccaagauccuguucaucgaggaggggaagaucguccacaucagcccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccagcuccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaacaugagcggcuacuccgggaucuucucggucgagggcaagagcugcaucaaccgcugcuucuacguggagcucauccggggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 17658 - RNA, 1410 nt, Artificial Sequence; identical to SEQ ID NO: 17587
  derived and/or modified CDS sequence (AUadapt) from InfluenzaA__ABG80406__NA

SEQ ID NO: 17659 - RNA, 1410 nt, Artificial Sequence; identical to SEQ ID NO: 17587
  derived and/or modified CDS sequence (AUadapt) from InfluenzaA__ABG80417__NA

SEQ ID NO: 17660 - RNA, 1410 nt, Artificial Sequence; identical to SEQ ID NO: 17587
  derived and/or modified CDS sequence (AUadapt) from InfluenzaA__ABG80428__NA

SEQ ID NO: 17661 - RNA, 1410 nt, Artificial Sequence; identical to SEQ ID NO: 16528
  derived and/or modified CDS sequence (AUadapt) from InfluenzaA__ABG88292__NA

SEQ ID NO: 17662 - RNA, 1413 nt, Artificial Sequence; identical to SEQ ID NO: 17452
  derived and/or modified CDS sequence (AUadapt) from InfluenzaA__ABG88314__NA

SEQ ID NO: 17663 - RNA, 1413 nt, Artificial Sequence
  derived and/or modified CDS sequence (AUadapt) from InfluenzaA__ABG88325__NA
augaaccccaaccagaagaucaucaccaucggcucgaccuccaucgccaucgggaucaucucgcugauccuccagaucggcaacaucaucuccaucugggccagccacuccauccagacggggucgcagaaccacaccggcaucugcaaccagcgcaucaucaccuacgagaacuccaccugggugaaccagacguacgucaacaucaacaacaccucggugguggcggggaaggacaagaccuccaugacccuggccggcaacagcucccugugcccgauccggggcugggccaucuacacgaaggacaacucgauccgcaucggguccaagggcgacgucuucgugauccgggagcccuucaucagcugcucccaccucgagugccgcaccuucuuccugacccagggggcccugcucaacgacaagcacucgaacggcaccgugaaggaccggucccccuaccgcgcccugaugucgugcccccugggggaggcgccgucccccuacaacagccgguucgagucggucgccugguccgccagcgccugccacgacggccucggcuggcugacgaucgggaucuccggccccgacaacggggcgguggccgugcugaaguacaacggcaucaucaccgagaccaucaagucguggaagaagcgcauccuccggacccaggaguccgagugcgucugcaugaacggcucgugcuucacgaucaugaccgacgggcccuccaacggcgccgccagcuaccgcaucuucaagaucgagaaggggcgggugaccaaguccaucgagcuggacgccccgaacuaccacuacgaggagugcucgugcuaccccgacaccggcacggugaugugcgucugccgcgacaacuggcacggguccaaccggcccugggugucguucaaccagaaccuggacuaccagaccggcuacaucugcuccggcguguucggggacaacccccgcccgaaggacggcgaggggagcugcaaccccgucaccgcggacggcgccgacggggugaagggcuucuccuaccgguacggcaacgggguguggaucggccgcaccaagucgaaccggcuccgcaagggguucgagaugaucugggaccccaacggcuggacggacaccgacuccgacuucagcaugaagcaggacaucgucgccaugaccgacugguccggguacucgggcucguucgugcagcaccccgagcugaccggccuggacugcaugcggccgugcuucuggguggagcucguccgcgggcugccccgggagaacacgaccaucuggaccuccggcagcuccaucucguucugcggggugaacuccgacaccgccaacuggagcuggcccgacggcgccgagcugcccuucacgaucgacaaguga

SEQ ID NO: 17664 - RNA, 1413 nt, Artificial Sequence
  derived and/or modified CDS sequence (AUadapt) from InfluenzaA__ABG88336__NA
augaaccccaaccagaagaucaucaccaucggcucgaucugcauggccaucgggaucaucucccugauccuccagaucggcaacaucaucagcaucugggugucccacucgauccagaccgggaaccagaaccacacgggcaucugcaaccagcgcaucaucaccuacgagaacuccaccugggucaaccagaccuacgugaacaucaacaacacgaacguggucgccgggaaggacaccaccagcgugacccuggcgggcaacuccucgcugugcccggugcggggcugggccaucuacuccaaggacaacagcauccgcaucggguccaagggcgacgucuucgugauccgggagcccuucaucucgugcucccaccucgagugccgcacguucuuccugacccagggggcccugcucaacgacaagcacagcaacggcaccgugaaggaccggucccccuaccgcgcccugaugucgugccccaucggggaggccccgucccccuacaacagccgguucgaguccgucgcguggucggccagcgccugccacgacggcaugggcuggcugaccaucgggaucuccggccccgacgacggggccguggcggugcucaaguacaacggcaucaucacggagaccaucaagagcuggcgcaagcggauccugcgcacccaggaguccgagugcgucugcgugaacggcucgugcuucaccaucaugacggacgggcccuccaacggcccggccagcuacaagaucuucaagaucgagaaggggaagaucaccaaguccaucgagcuggacgcccccaacucgcacuacgaggagugcuccugcuaccccgacaccggcaccgugaugugcgucugccgggacaacuggcacgggagcaaccgccccuggguguccuucaaccagaaccucgacuaccagcugggcuacaucugcucgggcaucuucggggacaacccgcggcccaaggacggcaagggguccugcggccccgugacggucgacggggccgacggcgugaagggcuucagcuaccgcuacgggaacggcguguggaucgggcggaccaaguccaacucgucccgcaagggcuucgagaugaucugggaccccaacggguggaccgacaccgacagcaacuuccuggucaagcaggacgugguggccaugacggacugguccggcuacucgggcagcuucguccagcacccggagcucaccgggcuggacugcaugcggcccugcuucuggguggagcugauccgcggccggccccgcgagaccaccacgaucuggaccuccgggucguccaucagcuucugcggcgucaacuccgacaccgugaacuggagcuggcccgacggcgcggagcucccguucaccaucgacaaguga

SEQ ID NO: 17665 - RNA, 1413 nt, Artificial Sequence
  derived and/or modified CDS sequence (AUadapt) from InfluenzaA__ABG88347__NA
augaaccccaaccagaagaucaucaccaucggcucgaucugcauggccaucgggaucaucggccugauccuccagaucgggaacaucaucuccaucugggugagccacuccauccagaccggcucgcagaaccacacggggaucugcaaccagcgcaucaucaccuacgagaacuccaccugggucaaccagaccuacgugaacaucaacaacacgaacguggucgccggcaaggacaccaccagcgugacccuggcgggcaacuccucgcugugcccggugcgggggugggccaucuacuccaaggacaacagcauccgcaucggcuccaagggggacgucuucgugauccgggagcccuucaucucgugcucccaccucgagugccgcacguucuuccugacccagggcgcccugcucaacgacaagcacagcaacgggaccgugaaggaccggucccccuaccgcgcccugaugucgugccccaucggcgaggccccgucccccuacaacagccgguucgaguccgucgcguggucggccagcgccugccacgacggcaugggguggcugaccaucggcaucuccgggcccgacgacggcgccguggcggugcucaaguacaacggcaucaucacggagaccaucaagagcuggcgcaagcggauccugcgcacccaggaguccgagugcgucugcgugaacgggucgugcuucaccaucaugacggacggccccuccaacgggccggccagcuacaagaucuucaagaucgagaagggcaagaucaccaaguccaucgagcuggacgcccccaacucgcacuacgaggagugcuccugcuaccccgacaccgggaccgugaugugcgucugccgggacaacuggcacggcagcaaccgccccuggguguccuucaaccagaaccucgacuaccagcugggcuacaucugcucggggaucuucggcgacaacccgcggcccaaggacgggaagggcuccugcgggcccgugacggucgacggcgccgacggcgugaagggguucagcuaccgcuacggcaacgggguguggaucggccggaccaaguccaacucgucccgcaagggguucgagaugaucugggaccccaacggcuggaccgacaccgacagcaacuuccuggucaagcaggacgugguggccaugacggacugguccggcuacucggggagcuucguccagcacccggagcucaccggccuggacugcaugcggcccugcuucuggguggagcugauccgcgggcggccccgcgagaccaccacgaucuggaccuccggcucguccaucagcuucugcggcgucaacuccgacaccgugaacuggagcuggcccgacggggcggagcucccguucaccaucgacaaguga

SEQ ID NO: 17666 - RNA, 1410 nt, Artificial Sequence
  derived and/or modified CDS sequence (AUadapt) from InfluenzaA__ABG88358__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccucgugccacgacggcaaggcguggcugcacgugugcgugaccgggcacgacaagaacgccaccgccuccuucaucuacgacggccggcugguggacagcaucggguccuggucgaagaacauccuccgcacccaggaguccgagugcgucugcaucaacggcacgugcaccguggugaugaccgacggcagcgccuccgaccgggcggacaccaagauccuguucaucgaggaggggaagaucguccacauccgcccccugucgggcagcgcccagcacguggaggagugcuccugcuacccccgguacccgggggugcgcugcgucugccgggacaacuggaagggcucgaaccgccccaucguggacaucaacgugaaggacuacuccaucgucucguccuacgugugcagcggccucgugggggacacgccccggaagaacgacuccucguccagcuccuacugcuggaaccccaacaacgagaagggcgggcacggcgucaaggggugggccuucgacgacggcaacgacguguggaugggccgcaccaucucggaggagucccggucgggguacgagaccuucaaggucaucggcgggugguccaagccgaacagcaagcugcagaucaaccgccaggugaucguggaccggggcaaccgcuccggguacucgggcaucuucuccgucgagggcaagagcugcaucaaccggugcuucuacguggagcugauccgcgggcgcaagcaggagaccgaggugugguggacgucgaacuccaucgucguguucugcggcaccagcgggaccuacggcaccggguccuggcccgacggcgccgacaucaaccucaugcccaucuga

SEQ ID NO: 17667 - RNA, 1410 nt, Artificial Sequence; identical to SEQ ID NO: 17515
  derived and/or modified CDS sequence (AUadapt) from InfluenzaA__ABG88369__NA

SEQ ID NO: 17668 - RNA, 1410 nt, Artificial Sequence; identical to SEQ ID NO: 17515
  derived and/or modified CDS sequence (AUadapt) from InfluenzaA__ABG88380__NA

SEQ ID NO: 17669 - RNA, 1410 nt, Artificial Sequence; identical to SEQ ID NO: 17515
  derived and/or modified CDS sequence (AUadapt) from InfluenzaA__ABG88391__NA

SEQ ID NO: 17670 - RNA, 1410 nt, Artificial Sequence; identical to SEQ ID NO: 17502
  derived and/or modified CDS sequence (AUadapt) from InfluenzaA__ABG88402__NA

SEQ ID NO: 17671 - RNA, 1410 nt, Artificial Sequence; identical to SEQ ID NO: 17559
  derived and/or modified CDS sequence (AUadapt) from InfluenzaA__ABG88413__NA

SEQ ID NO: 17672 - RNA, 1410 nt, Artificial Sequence; identical to SEQ ID NO: 17503
  derived and/or modified CDS sequence (AUadapt) from InfluenzaA__ABG88424__NA

SEQ ID NO: 17673 - RNA, 1410 nt, Artificial Sequence; identical to SEQ ID NO: 17503
  derived and/or modified CDS sequence (AUadapt) from InfluenzaA__ABG88435__NA

SEQ ID NO: 17674 - RNA, 1410 nt, Artificial Sequence; identical to SEQ ID NO: 17503
  derived and/or modified CDS sequence (AUadapt) from InfluenzaA__ABG88446__NA

SEQ ID NO: 17675 - RNA, 1410 nt, Artificial Sequence
  derived and/or modified CDS sequence (AUadapt) from InfluenzaA__ABG88457__NA
augaaccccaaccagaagaucaucaccaucggcucggugucccugaccacggccaccaucugcuuccucaugcagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcacgacccugaacaaccgccacagcaacgacaccguccacgaccggaccccguaccgcacgcuccugaugaacgagcugggcgugcccuuccaccucgggaccaagcaggucugcaucgccugguccucguccucgugccacgacggcaaggcguggcugcacgugugcgugaccgggcacgacgagaacgccaccgccuccuucaucuacgacggccggcugguggacagcaucggguccuggucgaagaacauccuccgcacgcaggaguccgagugcgucugcaucaacgggaccugcaccguggugaugaccgacggcagcgccuccgagcgggcggacacgaagauccuguucaucaaggagggcaagaucguccacaucucgccccugucgggcuccgcccagcacguggaggagugcagcugcuacccccgcuacccgggggugcggugcgucugccgcgacaacuggaagggcuccaaccggcccaucguggacaucaacgugaaggacuacucgaucgucuccagcuacgugugcuccggccucgugggggacacgccccgcaagaacgacucguccucguccagcuacugccagaaccccaacaacgagaagggcucccacggggucaagggcugggccuucgacgacgggaacgacguguggaugggccggaccaucucggaggagcugcgcuccggcuacgagaccuucaaggucaucgggggcuggagcaagccgaacuccaagcugcagaucaaccgccaggugaucguggaccgggggaaccggucgggcuacuccgggaucuucucggucgagggcaagagcugcaucaaccgcugcuucuacguggagcucauccggggccgcaagcaggagaccgaggugugguggaccuccaacucgaucgucguguucugcgggaccuccggcaccuacgggacgggcagcuggcccgacggggccgacaucaaccugaugcccaucuga

SEQ ID NO: 17676 - RNA, 1410 nt, Artificial Sequence; identical to SEQ ID NO: 17503
  derived and/or modified CDS sequence (AUadapt) from InfluenzaA__ABG88468__NA

SEQ ID NO: 17677 - RNA, 1410 nt, Artificial Sequence; identical to SEQ ID NO: 17503
  derived and/or modified CDS sequence (AUadapt) from InfluenzaA__ABG88479__NA

SEQ ID NO: 17678 - RNA, 1410 nt, Artificial Sequence; identical to SEQ ID NO: 17503
  derived and/or modified CDS sequence (AUadapt) from InfluenzaA__ABG88490__NA

SEQ ID NO: 17679 - RNA, 1410 nt, Artificial Sequence; identical to SEQ ID NO: 17503
  derived and/or modified CDS sequence (AUadapt) from InfluenzaA__ABG88501__NA

SEQ ID NO: 17680 - RNA, 1410 nt, Artificial Sequence; identical to SEQ ID NO: 17503
  derived and/or modified CDS sequence (AUadapt) from InfluenzaA__ABG88512__NA

SEQ ID NO: 17681 - RNA, 1410 nt, Artificial Sequence; identical to SEQ ID NO: 17503
  derived and/or modified CDS sequence (AUadapt) from InfluenzaA__ABG88523__NA

SEQ ID NO: 17682 - RNA, 1410 nt, Artificial Sequence
  derived and/or modified CDS sequence (AUadapt) from InfluenzaA__ABG88534__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccuccaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaagaucaccggguucgcccccuucuccaaggacaacucgauccgccucuccgccggcggggacaucugggugacccgggagcccuacgugagcugcgaccccggcaagugcuaccaguucgcccuggggcagggcaccacgcugaacaaccgccacuccaacgacaccguccacgaccggaccccguaccgcacccuccugaugaacgagcugggcgugcccuuccaccucgggacgaagcaggucugcaucgccuggucguccagcuccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccccgcuacccgggggugcggugcgucugccgcgacaacuggaagggcucgaaccggcccaucguggacaucaacgugaaggacuacuccaucgucagcuccuacgugugcucgggccucgugggggacacgccccgcaagaacgacuccagcuccucguccuacugccggaaccccaacaacgagaagggcagccacggggucaagggcugggccuucgacgacgggaacgacguguggaugggccgcaccaucuccgaggagcugcggucgggcuacgagaccuucaaggucaucgggggcugguccaagccgaacagcaagcugcagaucaaccgccaggugaucguggaccgggggaaccgcuccggcuacucggggaucuucagcgucgagaacaaguccugcaucaaccggugcuucuacguggagcucauccgcggccgcaagcaggagaccgaggugugguggacgucgaacuccaucgucguguucugcggcaccagcgggaccuacggcaccggguccuggcccgacggcgccgacaucaaccugaugcccaucuga

SEQ ID NO: 17683 - RNA, 1410 nt, Artificial Sequence; identical to SEQ ID NO: 17195
  derived and/or modified CDS sequence (AUadapt) from InfluenzaA__ABG88567__NA

SEQ ID NO: 17684 - RNA, 1410 nt, Artificial Sequence
  derived and/or modified CDS sequence (AUadapt) from InfluenzaA__ABG88600__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagccggcggaguaccggaacugguccaagccccagugcaacaucaccggguucgcccccuucagcaaggacaacuccauccgccugucggccggcggggacaucugggugacccgggagcccuacguguccugcgacccggacaagugcuaccaguucgcccucggccaggggaccacgcugaacaacggccacucgaacgacaccguccacgaccgcacccccuaccggacccugcucaugaacgagcugggcgugcccuuccaccuggggacgaagcaggucugcaucgccugguccagcuccucgugccacgacggcaaggcguggcuccacgugugcgugaccggggacgacgagaacgccaccgccuccuucaucuacaacggccgccugguggacagcaucggguccuggucgaagaagauccugcggacccaggaguccgagugcgucugcaucaacggcacgugcaccguggugaugaccgacggcucggccuccgggaaggcggacaccaagauccucuucaucgaggagggcaagaucguccacacgagccugcugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacucgaagcuccagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcuguggaccucgaacuccaucgucguguucugcggcaccagcgggaccuacggcacgggguccuggcccgacggcgccgacaucaaccucaugcccaucuga

SEQ ID NO: 17685 - RNA, 1410 nt, Artificial Sequence; identical to SEQ ID NO: 16556
  derived and/or modified CDS sequence (AUadapt) from InfluenzaA__ABG88611__NA

SEQ ID NO: 17686 - RNA, 1410 nt, Artificial Sequence; identical to SEQ ID NO: 16568
  derived and/or modified CDS sequence (AUadapt) from InfluenzaA__ABG88622__NA

SEQ ID NO: 17687 - RNA, 1410 nt, Artificial Sequence; identical to SEQ ID NO: 16556
  derived and/or modified CDS sequence (AUadapt) from InfluenzaA__ABG88633__NA

SEQ ID NO: 17688 - RNA, 1410 nt, Artificial Sequence; identical to SEQ ID NO: 17607
  derived and/or modified CDS sequence (AUadapt) from InfluenzaA__ABG88655__NA

SEQ ID NO: 17689 - RNA, 1410 nt, Artificial Sequence; identical to SEQ ID NO: 17607
  derived and/or modified CDS sequence (AUadapt) from InfluenzaA__ABG88666__NA

SEQ ID NO: 17690 - RNA, 1410 nt, Artificial Sequence; identical to SEQ ID NO: 16993
  derived and/or modified CDS sequence (AUadapt) from InfluenzaA__ABG88677__NA

SEQ ID NO: 17691 - RNA, 1410 nt, Artificial Sequence; identical to SEQ ID NO: 17607
  derived and/or modified CDS sequence (AUadapt) from InfluenzaA__ABG88688__NA

SEQ ID NO: 17692 - RNA, 1410 nt, Artificial Sequence; identical to SEQ ID NO: 16993
  derived and/or modified CDS sequence (AUadapt) from InfluenzaA__ABG88699__NA

SEQ ID NO: 17693 - RNA, 1410 nt, Artificial Sequence; identical to SEQ ID NO: 16729
  derived and/or modified CDS sequence (AUadapt) from InfluenzaA__ABG88710__NA

SEQ ID NO: 17694 - RNA, 1410 nt, Artificial Sequence; identical to SEQ ID NO: 16729
  derived and/or modified CDS sequence (AUadapt) from InfluenzaA__ABG88721__NA

SEQ ID NO: 17695 - RNA, 1410 nt, Artificial Sequence
  derived and/or modified CDS sequence (AUadapt) from InfluenzaA__ABG88732__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggagcgggggaaccgcagcggcuacuccgggaucuucucggucgagggcaagagcugcaucaaccggugcuucuacguggagcucauccgcggccgcaagcaggagaccgaggugugguggacguccaacucgaucgucguguucugcgggaccuccggcaccuacgggaccggcagcuggcccgacggggccgacaucaaccugaugcccaucuga

SEQ ID NO: 17696 - RNA, 1410 nt, Artificial Sequence; identical to SEQ ID NO: 17655
  derived and/or modified CDS sequence (AUadapt) from InfluenzaA__ABG88743__NA

SEQ ID NO: 17697 - RNA, 1410 nt, Artificial Sequence; identical to SEQ ID NO: 17655
  derived and/or modified CDS sequence (AUadapt) from InfluenzaA__ABG88754__NA

SEQ ID NO: 17698 - RNA, 1410 nt, Artificial Sequence; identical to SEQ ID NO: 16921
  derived and/or modified CDS sequence (AUadapt) from InfluenzaA__ABG88765__NA

SEQ ID NO: 17699 - RNA, 1410 nt, Artificial Sequence; identical to SEQ ID NO: 17587
  derived and/or modified CDS sequence (AUadapt) from InfluenzaA__ABG88776__NA

SEQ ID NO: 17700 - RNA, 1410 nt, Artificial Sequence; identical to SEQ ID NO: 17587
  derived and/or modified CDS sequence (AUadapt) from InfluenzaA__ABG88787__NA

SEQ ID NO: 17701 - RNA, 1410 nt, Artificial Sequence
  derived and/or modified CDS sequence (AUadapt) from InfluenzaA__ABG88820__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagcugcggcugggcuacgagaccuucaaggucaucgaggggugguccaaccccaacagcaagcuccagaccaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccucgaacuccaucgucguguucugcggcacgagcgggaccuacggcaccggguccuggccggacggcgccgacaucaaccucaugcccaucuga

SEQ ID NO: 17702 - RNA, 1350 nt, Artificial Sequence
  derived and/or modified CDS sequence (AUadapt) from InfluenzaA__ABI16506__NA
augaaucccaaccaaaagaucaucaccaucggcagcaucugcauggugaucgggaucgucucccugaugcuccagaucggcaacauggugagccugugggugucccacagcauccagaccgggaaucagcaccaggucgagccgaucuccaacacgaacuuccugaccgagaaggccguggccagcgugacccucgcgggcaacuccagccugugucccauccgcgggugggccguccacuccaaggacaacagcauccggaucggcuccaaaggcgacguguucgugauccgcgagcccuucaucagcuguucccaccuggagugccggaccuucuuccucacgcagggggcccugcugaacgacaagcacaguaacggcaccgucaaggaccgcagcccccaccggacccucauguccugcccggugggggaggcccccucccccuacaacagccgcuuugaguccguggccuggagcgcgagcgccugccacgacggcaccuccuggcugacgaucgggaucagcggccccgacaauggcgccgucgccgugcugaaguacaacgggaugaucaccgacaccaucaaguccuggcggaacaacauccuccgcacccaagagagcgagugcgugugcgucaauggcuccugcuucacggugaugaccgacgggccgagcaacggccaggcguccuacaagaucuucaagauggagaagggcaagguggucaagaguguggagcuggacgcccccaacuaccacuacgaagagugcuccugcuaucccgacgccggggagaucacgugcgugugccgggacaacuggcacggcagcaaccgccccugggucuccuuuaaccagaaccuggaguaccagaucggguacaucugcagcggcguguucggggauaacccgcggcccaacgacggcaccggcuccugcgggcccgugagccccaacggcgccuacggggucaagggcuucuccuuuaaguacgggaacggcguguggaucggccgcaccaagagcccguccagccgguccggguucgagaugaucugggaccccaacggcuggaccgaaaccgauagcagcuucuccgucaagcaggacaucguggccaucaccgacuggagcggguacuccggcagcuuugugcagcaccccgagcucacggggcuggacugcauccgccccugcuucugggucgagcugauccggggccgcccgaaggaguccaccaucuggaccagcggcuccagcaucuccuuuugcggggugaacagcgacaccguguccuggagcuggcccgacggcgcggagcuccccuucacgaucgacaaguga

SEQ ID NO: 17703 - RNA, 1413 nt, Artificial Sequence; identical to SEQ ID NO: 17367
  derived and/or modified CDS sequence (AUadapt) from InfluenzaA__ABI20840__NA

SEQ ID NO: 17704 - RNA, 1413 nt, Artificial Sequence
  derived and/or modified CDS sequence (AUadapt) from InfluenzaA__ABI20862__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgcccuaccgcgcccugauguccugccccaucggggaggccccgagccccuacaacucccgguucgagucgguggccuggagcgcguccgccugccacgacggcaugggcuggcugacgaucgggaucucgggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccucgaacggcccggcguccuaccggaucuucaagaucgagaaggggaagaucaccaagagcaucgagcuggacgcccccaacucccacuacgaggagugcucgugcuaccccgacaccggcacggugaugugcgugugccgcgacaacuggcacggguccaaccggcccugggucagcuucaaccagaaccucgacuaccagaccggcuacaucugcuccggcguguucggggacaacccgcgccccaaggacggcaaggggucgugcgaccccgugaccgucgacggcgccgacggggugaagggcuucuccuaccgguacggcaacgggguguggaucggccgcaccaagagcaacuccucgcggaagggguucgagaugaucugggaccccaacggcuggacggacaccgacuccaacuuccuggucaagcaggacgugguggccaugaccgacuggagcggguacucgggcuccuucguccagcacccggagcugaccggccucgacugcaugcgccccugcuucuggguggagcugauccgggggcgcccccgggagaagacgaccaucuggaccagcggcuccucgaucuccuucugcggggucaacagcgacaccgccaacugguccuggcccgacggcgcggagcugccguucacgaucgacaaguga

SEQ ID NO: 17705 - RNA, 1413 nt, Artificial Sequence
  derived and/or modified CDS sequence (AUadapt) from InfluenzaA__ABI20873__NA
augaaccccaaccagaagaucaucaccaucggcucgaucuccauggccaucgggaucaucucgcugacccuccagaucggcaacaucaucuccaucugggccagccacuccauccagacggggucgcagaaccacaccggcaucugcaaccagcgcaucaucaccuacgagaacuccaccugggugaaccagacguacgucaacaucaacaacaccaacgugguggcggagaaggacaagaccagcgucacccuggccgggaacuccucgcugugcccgauccggggcugggccaucuacacgaaggacaacuccauccgcaucggcagcaagggggacguguucgugauccgggagcccuucaucuccugcucgcaccucgagugccgcaccuucuuccugacccagggcgcccugcucaacgacaagcacuccaacgggaccgucaaggaccggucgcccuaccgcgcccugauguccugcccccugggcgaggcgccgagccccuacaacucccgguucgagucgguggccuggagcgccacggccugccacgacgggaucggcuggcucaccaucggcaucuccgggcccgacaacggcgcgguggccguccugaaguacaacggggugaucaccgagaccaucaagucguggaagaagcagauccugcgcacgcaggaguccgagugcgugugcgucaacggcagcugcuucaccaucaugaccgacggccccuccaacggggccgccucguaccggaucuucaagaucgagaagggcaagaucaccaaguccaucgagcucgacgccccgaacuuccacuacgaggagugcagcugcuaccccgacacggggaccgugaugugcgugugccgcgacaacuggcacggcuccaaccggcccugggucucguucaaccagaaccuggacuaccagaucggguacaucugcuccggcguguucggcgacaacccccgcccgaaggacggggagggcucgugcaaccccgugaccgucgacggggcggacggcgugaagggguucuccuaccgguacggcaacggcguguggaucgggcgcaccaagagcaaccggcugcgcaagggcuucgagaucaucugggaccccaacggguggacggacaccgacuccgacuucucggucaagcaggacgugguggccaugaccgacugguccggcuacagcggguccuucguccagcaccccgagcucaccggccuggacugcaugcggccgugcuucuggguggagcugguccgcggccucccccgggagaacgccacgaucuggaccucggggagcuccaucucguucugcggcgugaacuccgacaccgccaacuggagcuggcccgacggggccgagcugcccuucaccaucgacaaguga

SEQ ID NO: 17706 - RNA, 1410 nt, Artificial Sequence; identical to SEQ ID NO: 17502
  derived and/or modified CDS sequence (AUadapt) from InfluenzaA__ABI20895__NA

SEQ ID NO: 17707 - RNA, 1410 nt, Artificial Sequence; identical to SEQ ID NO: 17515
  derived and/or modified CDS sequence (AUadapt) from InfluenzaA__ABI20906__NA

SEQ ID NO: 17708 - RNA, 1410 nt, Artificial Sequence; identical to SEQ ID NO: 17503
  derived and/or modified CDS sequence (AUadapt) from InfluenzaA__ABI20928__NA

SEQ ID NO: 17709 - RNA, 1410 nt, Artificial Sequence; identical to SEQ ID NO: 17503
  derived and/or modified CDS sequence (AUadapt) from InfluenzaA__ABI20939__NA

SEQ ID NO: 17710 - RNA, 1410 nt, Artificial Sequence; identical to SEQ ID NO: 17503
  derived and/or modified CDS sequence (AUadapt) from InfluenzaA__ABI20950__NA

SEQ ID NO: 17711 - RNA, 1410 nt, Artificial Sequence; identical to SEQ ID NO: 17503
  derived and/or modified CDS sequence (AUadapt) from InfluenzaA__ABI20961__NA

SEQ ID NO: 17712 - RNA, 1410 nt, Artificial Sequence; identical to SEQ ID NO: 17229
  derived and/or modified CDS sequence (AUadapt) from InfluenzaA__ABI20983__NA

SEQ ID NO: 17713 - RNA, 1410 nt, Artificial Sequence
  derived and/or modified CDS sequence (AUadapt) from InfluenzaA__ABI20994__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacaaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 17714 - RNA, 1410 nt, Artificial Sequence
  derived and/or modified CDS sequence (AUadapt) from InfluenzaA__ABI21005__NA
augaaccccaaccagaagaucaucaccaucggcucggugucccugaccaucgccacgaucugcuuccucaugcagaucgccguccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaacggccacucgaacgacaccgugcacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccuggccgacagcaucggguccuggucgaagaagauccuccggacccaggaguccgagugcgucugcaucaacggcacgugcaccguggugaugaccgacggcucggcguccgggaaggccgacaccaagauccuguucaucgaggagggcaagaucguccacacgagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 17715 - RNA, 1410 nt, Artificial Sequence; identical to SEQ ID NO: 16556
  derived and/or modified CDS sequence (AUadapt) from InfluenzaA__ABI21016__NA

SEQ ID NO: 17716 - RNA, 1410 nt, Artificial Sequence
  derived and/or modified CDS sequence (AUadapt) from InfluenzaA__ABI21027__NA
augaaccccaaccagcgcaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcggaacaucaccgagaucgucuaccugaccaacaccacgaucgagaaggagaucugccccaagcuggcggaguaccgcaacugguccaagccgcagugcaacaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaacggccacucgaacgacaccguccacgaccggaccccguaccgcacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcagcugcuacccccgcuaccccggcgugcggugcgucugccgcgacaacuggaagggcuccaaccggccgaucguggacaucaacgugaaggacuacucgaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaccaaccgccaggugaucguggagcggggcaaccggucgggguacuccggcaucuucagcgucgagggcaaguccugcaucaaccgcugcuucuacguggagcugauccgggggcgcaaggaggagaccgaggugugguggaccucgaacagcaucgucguguucugcggcaccccggggacguacggcaccggguccuggcccgacggcgccgacaucaaccugaugcccaucuga

SEQ ID NO: 17717 - RNA, 1410 nt, Artificial Sequence; identical to SEQ ID NO: 16993
  derived and/or modified CDS sequence (AUadapt) from InfluenzaA__ABI21038__NA

SEQ ID NO: 17718 - RNA, 1410 nt, Artificial Sequence
  derived and/or modified CDS sequence (AUadapt) from InfluenzaA__ABI21049__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggucgaagaagauccuccgcacccaggaguccgagugcgugugcaucaacggcacgugcaccguggucaugaccgacggcagcgccuccgggaaggccgacaccaagauccuguucaucgaggagggcaagaucgugcacaucucgacgcugagcggguccgcgcagcacguggaggagugcucgugcuacccccgguaccccggcguccgcugcgugugccgggacaacuggaagggcuccaaccgcccgaucguggacaucaacgucaaggacuacagcaucguguccggguacgugugcucgggccucgucggggacacgccccggaagaacgacuccuucucguccagccacugccuggaccccaacaacgaggagggcgggcacggcgugaagggcugggccuucgacgacgggaacgacgucuggaugggccgcaccaucuccgagaagcugcggucgggguacgagaccuucaaggugaucgagggcugguccaagcccaacagcaagcuccagaucaaccgccaggugaucgucgagcgggggaaccgcuccggcuacucgggcaucuucuccguggagggcaagagcugcaucaaccggugcuucuacguggagcugauccgcgggcggaaggaggagaccgaggucugguggaccuccaacucgaucgugguguucugcgggaccagcggcaccuacgggacgggcuccuggccggacggcgccgacaucaaccugaugcccaucuga

SEQ ID NO: 17719 - RNA, 1410 nt, Artificial Sequence
  derived and/or modified CDS sequence (AUadapt) from InfluenzaA__ABI21060__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagccgguggaguaccggaacugguccaagccccagugcaacaucaccggguucgcgcccuucagcaaggacaacuccauccgccugucggccggcggggacaucugggugacccgggagcccuacgucuccugcgacccggacaagugcuaccaguucgcccucggccaggggaccacgcugaacaacggccacagcaacgacaccgugcacgaccgcacccccuaccggacccugcucaugaacgagcugggcgugcccuuccaccuggggacgcgccaggucugcaucgccugguccucguccucgugccacgacggcaaggccuggcuccacgugugcgugaccggggacgacaagaacgcgaccgccuccuucaucuacaacggccggcuggucgacagcaucggguccuggucgaagaagauccugcgcacccaggaguccgagugcgugugcaucaacggcacgugcaccguggucaugaccgacggcagcgccuccgggaaggccgacaccaagauccucuucaucgaggagggcaagaucgugcacaucucgacgcugagcggguccgcgcagcacguggaggagugcucgugcuacccccgguacccgggcguccgcugcgugugccgggacaacuggaagggcuccaaccgccccaucguggacaucaacgucaaggacuacucgaucguguccagcuacgugugcuccgggcuggucggcgacacgccccggaagaacgacucguucuccagcucccacugccucgaccccaacaacgaggagggcgggcacggggugaagggcugggccuucgacgacggcaacgacgucuggauggggcgcaccaucucggagaagcugcgguccggcuacgagaccuucaaggugaucgagggguggucgaagccgaacuccaagcugcagaucaaccgccaggugaucgucgagcggggcaaccgcagcggguacuccggcaucuucucgguggagggcaaguccugcaucaaccggugcuucuacguggagcucauccgcgggcggaaggaggagaccgaggucugguggaccagcaacucgaucgugguguucugcggcaccuccgggaccuacggcacggggagcuggcccgacggcgccgacaucaaccugaugcccaucuga

SEQ ID NO: 17720 - RNA, 1410 nt, Artificial Sequence
  derived and/or modified CDS sequence (AUadapt) from InfluenzaA__ABI21071__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugucggagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 17721 - RNA, 1410 nt, Artificial Sequence
  derived and/or modified CDS sequence (AUadapt) from InfluenzaA__ABI21082__NA
augaaccccaaccagaagaucaucaccaucggcucggugucccugaccaucagcacgaucugcuucuucaugcagaucgccacccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 17722 - RNA, 1410 nt, Artificial Sequence; identical to SEQ ID NO: 17138
  derived and/or modified CDS sequence (AUadapt) from InfluenzaA__ABI21093__NA

SEQ ID NO: 17723 - RNA, 1410 nt, Artificial Sequence
  derived and/or modified CDS sequence (AUadapt) from InfluenzaA__ABI21104__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucgccaacaccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccucguccugccacgacgggaaggcguggcuccacgugugcgugacgggcgacgacaagaacgccaccgccagcuucaucuacaacgggcgccugguggacuccaucgucucgugguccaaggagauccugcggacccaggagagcgagugcgugugcaucaacgggaccugcacgguggucaugaccgacggguccgccucgggcaaggcggacaccaagauccucuucaucgaggagggcaagaucgugcacaccagcacgcuguccgggagcgcccagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggucgaaccccaacuccaagcugcagaucaaccgccaggugaucguggaccggggcaaccggagcggguacuccggcaucuucucggucgaggggaagaacugcaucaaccgcugcuucuacguggagcucauccggggccgcaaggaggagaccgaggugcuguggaccagcaacuccaucgucguguucugcggcaccagcgggaccuacggcacgggguccuggccggacggcgccgacaucaaccugaugcccaucuga

SEQ ID NO: 17724 - RNA, 1410 nt, Artificial Sequence; identical to SEQ ID NO: 16729
  derived and/or modified CDS sequence (AUadapt) from InfluenzaA__ABI21115__NA

SEQ ID NO: 17725 - RNA, 1410 nt, Artificial Sequence; identical to SEQ ID NO: 16729
  derived and/or modified CDS sequence (AUadapt) from InfluenzaA__ABI21126__NA

SEQ ID NO: 17726 - RNA, 1410 nt, Artificial Sequence; identical to SEQ ID NO: 17138
  derived and/or modified CDS sequence (AUadapt) from InfluenzaA__ABI21137__NA

SEQ ID NO: 17727 - RNA, 1410 nt, Artificial Sequence; identical to SEQ ID NO: 16729
  derived and/or modified CDS sequence (AUadapt) from InfluenzaA__ABI21148__NA

SEQ ID NO: 17728 - RNA, 1410 nt, Artificial Sequence
  derived and/or modified CDS sequence (AUadapt) from InfluenzaA__ABI21159__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcggcuacgugugcuccggccuggugggggacacgccccgcaagaacgacucguccagcuccucgcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 17729 - RNA, 1410 nt, Artificial Sequence; identical to SEQ ID NO: 16729
  derived and/or modified CDS sequence (AUadapt) from InfluenzaA__ABI21170__NA

SEQ ID NO: 17730 - RNA, 1410 nt, Artificial Sequence; identical to SEQ ID NO: 16729
  derived and/or modified CDS sequence (AUadapt) from InfluenzaA__ABI21181__NA

SEQ ID NO: 17731 - RNA, 1413 nt, Artificial Sequence
  derived and/or modified CDS sequence (AUadapt) from InfluenzaA__ABI21192__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacggggaccugcaaccagcgcaucaucaccuacgagaacuccaccugggugaaccacacguacgucaacaucaacaacaccaacgugguggcgggcaaggacaagaccucggucacccuggccggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucacgaucgggaucagcggccccgacaacggggcgguggccguccugaaguacaacggcaucaucaccgagaccaucaaguccuggcgcaagcggauccugcgcacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuacccggacaccggcacggugaugugcgugugccgggacaacuggcacgggagcaaccgccccugggucuccuucaaccagaaccuggacuaccagaucggcuacaucugcucgggcguguucggggacaacccccggcccaaggacggcaagggguccugcaacccggugaccgucgacggcgcggacggggugaagggcuucagcuacaaguacggcaacgggguguggaucggccgcaccaaguccaaccggcugcgcaagggguucgagaugaucugggaccccaacggcuggaccgacacggacagcgacuucuccgucaagcaggacgugguggccaucaccgacuggucgggguacagcggcuccuucguccagcaccccgagcucaccggccuggacugcauccggcccugcuucuggguggagcugguccgcgggcucccgcgggagaacaccacgaucuggaccucgggcuccagcaucuccuucugcgggguggacagcgacaccgccaacugguccuggcccgacggcgccgagcugcccuucaucaucgacaaguga

SEQ ID NO: 17732 - RNA, 1413 nt, Artificial Sequence; identical to SEQ ID NO: 16788
  derived and/or modified CDS sequence (AUadapt) from InfluenzaA__ABI21203__NA

SEQ ID NO: 17733 - RNA, 1413 nt, Artificial Sequence
  derived and/or modified CDS sequence (AUadapt) from InfluenzaA__ABI21214__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaucaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacucggacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 17734 - RNA, 1410 nt, Artificial Sequence
  derived and/or modified CDS sequence (AUadapt) from InfluenzaA__ABI21247__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacucgaacgacaccguccacgaccggaccccguaccgcacccuccugaugaacgagcugggcgugcccuuccaccucgggacgaagcaggucugcaucgccugguccagcuccucgugccacgacggcaaggcguggcugcacgugugcgugaccgggcacgacgagaacgccaccgccuccuucaucuacgacggccggcugguggacucgaucggguccuggagcaagaacauccuccgcacccaggaguccgagugcgucugcaucaacggcacgugcaccguggugaugaccgacggcucggccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaaggaccacagcaucgucuccucguacgugugcuccggccucgugggggacacgccccgcaagaacgacucguccagcuccucguacugccggaaccccaacaacgagaagggcucccacgggaugaagggcugggccuucgacgacgggaacgacgucuggaugggccgcaccaucucggaggagcugcgguccggcuacgagaccuucaaggugaucgggggcuggagcaagccgaacuccaagcugcagaucaaccgccaggucaucguggaccgggggaaccgcucgggcuacuccgggaucuucucgguggagggcaagagcugcaucaaccggugcuucuacgucgagcucauccgcggccgcaagcaggagaccgaggugugguggacguccaacucgaucguggucuucugcgggaccuccggcaccuacgggaccggcagcuggcccgacggggccgacaucaaccugaugcccaucuga

SEQ ID NO: 17735 - RNA, 1410 nt, Artificial Sequence; identical to SEQ ID NO: 17655
  derived and/or modified CDS sequence (AUadapt) from InfluenzaA__ABI21258__NA

SEQ ID NO: 17736 - RNA, 1410 nt, Artificial Sequence; identical to SEQ ID NO: 17655
  derived and/or modified CDS sequence (AUadapt) from InfluenzaA__ABI21269__NA

SEQ ID NO: 17737 - RNA, 1410 nt, Artificial Sequence; identical to SEQ ID NO: 17655
  derived and/or modified CDS sequence (AUadapt) from InfluenzaA__ABI21280__NA

SEQ ID NO: 17738 - RNA, 1410 nt, Artificial Sequence; identical to SEQ ID NO: 17587
  derived and/or modified CDS sequence (AUadapt) from InfluenzaA__ABI21302__NA

SEQ ID NO: 17739 - RNA, 1410 nt, Artificial Sequence; identical to SEQ ID NO: 17587
  derived and/or modified CDS sequence (AUadapt) from InfluenzaA__ABI21313__NA

SEQ ID NO: 17740 - RNA, 1410 nt, Artificial Sequence; identical to SEQ ID NO: 17587
  derived and/or modified CDS sequence (AUadapt) from InfluenzaA__ABI21324__NA

SEQ ID NO: 17741 - RNA, 1410 nt, Artificial Sequence; identical to SEQ ID NO: 17587
  derived and/or modified CDS sequence (AUadapt) from InfluenzaA__ABI21335__NA

SEQ ID NO: 17742 - RNA, 1410 nt, Artificial Sequence; identical to SEQ ID NO: 17655
  derived and/or modified CDS sequence (AUadapt) from InfluenzaA__ABI21346__NA

SEQ ID NO: 17743 - RNA, 1410 nt, Artificial Sequence
  derived and/or modified CDS sequence (AUadapt) from InfluenzaA__ABI21357__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgucugcaucaacggcacgugcaccguggugaugaccgacggcagcgccuccgagcgggcggacaccaagauccuguucaucgaggaggggaagaucguccacaucucgccccugagcggcuccgcccagcacguggaggagugcucgugcuacccccgcuacccgggggugcggugcgucugccgcgacaacuggaagggcuccaaccggcccaucguggacaucaacgugaagaacuacagcaucgucuccucguacgugugcuccggccucgugggggacacgccccgcaagaacgacagcuccucguccucguacugccggaaccccaacaacgagaagggcucccacggggucaagggcugggccuucgacgacgggaacgacguguggaugggccgcaccaucagcgaggagcugcgguccggcuacgagaccuucaaggucaucgggggcuggucgaagccgaacuccaagcugcagaucaaccgccaggugaucguggaccgggggaaccgcagcggcuacuccgggaucuucucggucgagggcaagagcugcaucaaccggugcuucuacguggagcucauccgcggccgcaagcaggaggccgaggugugguggaccuccaacucgaucgucguguucugcgggacguccggcaccuacgggaccggcagcuggcccgacggggccgacaucaaccugaugcccaucuga

SEQ ID NO: 17744 - RNA, 1410 nt, Artificial Sequence; identical to SEQ ID NO: 17587
  derived and/or modified CDS sequence (AUadapt) from InfluenzaA__ABI21368__NA

SEQ ID NO: 17745 - RNA, 1410 nt, Artificial Sequence; identical to SEQ ID NO: 17587
  derived and/or modified CDS sequence (AUadapt) from InfluenzaA__ABI21379__NA

SEQ ID NO: 17746 - RNA, 1410 nt, Artificial Sequence; identical to SEQ ID NO: 17587
  derived and/or modified CDS sequence (AUadapt) from InfluenzaA__ABI21390__NA

SEQ ID NO: 17747 - RNA, 1410 nt, Artificial Sequence; identical to SEQ ID NO: 17655
  derived and/or modified CDS sequence (AUadapt) from InfluenzaA__ABI21401__NA

SEQ ID NO: 17748 - RNA, 1410 nt, Artificial Sequence
  derived and/or modified CDS sequence (AUadapt) from InfluenzaA__ABI21412__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaagaucaccggguucgcccccuucuccaaggacaacagcauccgccucuccgccggcggggacaucugggugacccgggagcccuacgugucgugcgacccgggcaagugcuaccaguucgcccuggggcagggcaccacgcugaacaaccgccacuccaacgacaccguccacgaccggacccccuaccgcacccuccugaugaacgagcugggcgugcccuuccaccucgggacgaagcaggucugcaucgccuggagcuccucguccugccacgacggcaaggcguggcugcacgugugcgugaccgggcacgacgagaacgccaccgccucguucaucuacgacggccggcugguggacuccaucgggagcugguccaagaacauccuccgcacccaggagucggagugcgucugcaucaacggcacgugcaccguggugaugaccgacggcuccgccagcgagcgggcggacaccaagauccuguucaucgaggaggggaagaucguccacaucucgccccuguccggcagcgcccagcacguggaggagugcuccugcuacccgcgcuaccccggggugcggugcgucugccgcgacaacuggaagggcucgaaccggcccaucguggacaucaacgugaaggacuacuccaucgucucguccuacgugugcagcggccucgugggggacacgccccgcaagaacgacuccucguccagcuccuacugccggaacccgaacaacgagaagggcucgcacggggucaagggcugggccuucgacgacgggaacgacguguggaugggccgcaccaucuccgaggagcugcggucgggcuacgagaccuucaaggucaucgggggcugguccaagcccaacagcaagcugcagaucaaccgccaggugaucguggaccgggggaaccgcuccggcuacucggggaucuucuccgucgagggcaagagcugcaucaaccggugcuucuacguggagcucauccgcggccgcaagcaggagaccgaggugugguggacgucgaacuccaucgucguguucugcgggaccagcggcaccuacgggaccggcuccuggcccgacggggccgacaucaaccugaugcccaucuga

SEQ ID NO: 17749 - RNA, 1410 nt, Artificial Sequence; identical to SEQ ID NO: 16921
  derived and/or modified CDS sequence (AUadapt) from InfluenzaA__ABI21423__NA

SEQ ID NO: 17750 - RNA, 1410 nt, Artificial Sequence; identical to SEQ ID NO: 17587
  derived and/or modified CDS sequence (AUadapt) from InfluenzaA__ABI21434__NA

SEQ ID NO: 17751 - RNA, 1410 nt, Artificial Sequence; identical to SEQ ID NO: 17655
  derived and/or modified CDS sequence (AUadapt) from InfluenzaA__ABI21445__NA

SEQ ID NO: 17752 - RNA, 1410 nt, Artificial Sequence; identical to SEQ ID NO: 17655
  derived and/or modified CDS sequence (AUadapt) from InfluenzaA__ABI21456__NA

SEQ ID NO: 17753 - RNA, 1410 nt, Artificial Sequence; identical to SEQ ID NO: 17748
  derived and/or modified CDS sequence (AUadapt) from InfluenzaA__ABI21467__NA

SEQ ID NO: 17754 - RNA, 1410 nt, Artificial Sequence; identical to SEQ ID NO: 17655
  derived and/or modified CDS sequence (AUadapt) from InfluenzaA__ABI21478__NA

SEQ ID NO: 17755 - RNA, 1410 nt, Artificial Sequence; identical to SEQ ID NO: 17655
  derived and/or modified CDS sequence (AUadapt) from InfluenzaA__ABI21489__NA

SEQ ID NO: 17756 - RNA, 1410 nt, Artificial Sequence; identical to SEQ ID NO: 17655
  derived and/or modified CDS sequence (AUadapt) from InfluenzaA__ABI21500__NA

SEQ ID NO: 17757 - RNA, 1410 nt, Artificial Sequence
  derived and/or modified CDS sequence (AUadapt) from InfluenzaA__ABI21511__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaugugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacgacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 17758 - RNA, 1413 nt, Artificial Sequence
  derived and/or modified CDS sequence (AUadapt) from InfluenzaA__ABI21533__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugaugcgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaucaagucgaucgagcucaacgcccccaacucccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcgaggggagcugcaacccggugaccgucgacggcgcggacggggugaagggcuucuccuacaaguacggcaacgggguguggaucggccggaccaagucgaaccgccugcggaagggguucgagaugaucugggaccccaacggcuggacggacaccgacuccgacuucagcgucaagcaggacgugguggccaucaccgacuggucgggguacuccggcagcuucguccagcaccccgagcucacgggccuggacugcauccgccccugcuucuggguggagcugguccgggggcgcccgcgggagaacaccaccaucuggaccuccggcucguccaucagcuucugcggggugaacuccgacacggccaacuggagcuggcccgacggcgccgagcuccccuucaccaucgacaaguga

SEQ ID NO: 17759 - RNA, 1413 nt, Artificial Sequence; identical to SEQ ID NO: 17758
  derived and/or modified CDS sequence (AUadapt) from InfluenzaA__ABI21544__NA

SEQ ID NO: 17760 - RNA, 1413 nt, Artificial Sequence; identical to SEQ ID NO: 17758
  derived and/or modified CDS sequence (AUadapt) from InfluenzaA__ABI21555__NA

SEQ ID NO: 17761 - RNA, 1413 nt, Artificial Sequence; identical to SEQ ID NO: 17758
  derived and/or modified CDS sequence (AUadapt) from InfluenzaA__ABI21566__NA

SEQ ID NO: 17762 - RNA, 1413 nt, Artificial Sequence; identical to SEQ ID NO: 17758
  derived and/or modified CDS sequence (AUadapt) from InfluenzaA__ABI21577__NA

SEQ ID NO: 17763 - RNA, 1413 nt, Artificial Sequence
  derived and/or modified CDS sequence (AUadapt) from InfluenzaA__ABI22112__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacgagaucaucacggagaccaucaaguccuggaagaagcgcauccugcggacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggguacaucugcucgggcguguucggcgacaacccccgccccaaggacgggaagggcuccugcaacccggugacggucgacggggcggacggcgugaagggguucagcuacaaguacggcaacggcguguggaucgggcggaccaaguccaaccgccugcggaagggcuucgagaugaucugggaccccaacggguggaccgacaccgacagcgacuucuccgucaagcaggacgugguggccaucacggacuggucgggcuacagcggguccuucguccagcaccccgagcucaccggccuggacugcauccgccccugcuucuggguggagcugguccggggccucccgcgcgagaacaccaccaucuggacgucgggguccagcaucuccuucugcggcguggacagcgacaccgccaacugguccuggcccgacggggccgagcugcccuucaccaucgacaaguga

SEQ ID NO: 17764 - RNA, 1410 nt, Artificial Sequence
  derived and/or modified CDS sequence (AUadapt) from InfluenzaA__ABI22162__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucgaccugaugcccaucuga

SEQ ID NO: 17765 - RNA, 1350 nt, Artificial Sequence
  derived and/or modified CDS sequence (AUadapt) from InfluenzaA__ABI23981__NA
augaaucccaaccaaaagaucaucaccaucggcagcaucugcauggugaucgggaucgucucccugaugcuccagaucggcaacaugaucagcaucugggugucccacagcauccagaccgggaaucagcgccaggccgaguccaucagcaacacgaaguuccugaccgagaaggccguggcguccgucacccuggccggcaacagcucccucugcccgaucagcgggugggccguguacuccaaggauaacagcauccggaucggcucccgcggcgacguguucgucauccgggagcccuucaucagcugcucccaccuggagugucgcaccuucuuccugacgcagggggcccuccugaacgacaagcacagcaacggcaccgugaaggaccggucccccuaucgcacccugaugagcucccccgugggggaggccccgagccccuacaacagccgguucgaauccgucgcguggagcgccuccgccugccaugacggcaccagcuggcucacgaucgggaucuccggccccgacaacggcgccguggcggugcugaaguacaacgggaucaucaccgacaccaucaagagcuggcgcaauaacauccugcggacccaggaguccgagugcgccugcgucaacggcagcugcuucacggugaugaccgacgggcccuccaauggccaggccagcuacaagaucuucaagauggagaagggcaagguggucaaguccguggagcucgacgccccgaacuaccacuacgaggaguguagcugcuaccccgacgccggggagaucacgugcgugugccgcgacaacuggcauggcuccaaccggcccugggucagcuucaaccaaaaccuggaguaccagaucggguacaucugcuccggcguguuuggggacaacccccgcccgaacgacggcaccggcagcugcgggcccgugucccugaacggcgcguacggggucaagggcuuuagcuucaaguacgggaacggcguguggaucggccggaccaaguccaccaacagccgcagcggguucgagaugaucugggaucccaacggcuggaccgggaccgacuccagcuucuccgugaagcaggacaucgucgccaucacggacuggagcggcuacuccgggaguuucgugcagcaccccgagcucaccggccuggacugcauccggccgugcuucugggucgagcugauccgcggccggcccaaggaguccaccaucuggaccagcggguccagcaucuccuuuugcggcgugaacagcgacacgguguccuggagcuggcccgacggggccgagcuccccuucaccaucgacaaguga

SEQ ID NO: 17766 - RNA, 1410 nt, Artificial Sequence; identical to SEQ ID NO: 16729
  derived and/or modified CDS sequence (AUadapt) from InfluenzaA__ABI26649__NA

SEQ ID NO: 17767 - RNA, 1413 nt, Artificial Sequence; identical to SEQ ID NO: 17452
  derived and/or modified CDS sequence (AUadapt) from InfluenzaA__ABI30370__NA

SEQ ID NO: 17768 - RNA, 1410 nt, Artificial Sequence; identical to SEQ ID NO: 17503
  derived and/or modified CDS sequence (AUadapt) from InfluenzaA__ABI30392__NA

SEQ ID NO: 17769 - RNA, 1410 nt, Artificial Sequence; identical to SEQ ID NO: 17132
  derived and/or modified CDS sequence (AUadapt) from InfluenzaA__ABI30403__NA

SEQ ID NO: 17770 - RNA, 1410 nt, Artificial Sequence; identical to SEQ ID NO: 17132
  derived and/or modified CDS sequence (AUadapt) from InfluenzaA__ABI30414__NA

SEQ ID NO: 17771 - RNA, 1410 nt, Artificial Sequence; identical to SEQ ID NO: 16729
  derived and/or modified CDS sequence (AUadapt) from InfluenzaA__ABI30425__NA

SEQ ID NO: 17772 - RNA, 1410 nt, Artificial Sequence; identical to SEQ ID NO: 16729
  derived and/or modified CDS sequence (AUadapt) from InfluenzaA__ABI30436__NA

SEQ ID NO: 17773 - RNA, 1410 nt, Artificial Sequence; identical to SEQ ID NO: 16729
  derived and/or modified CDS sequence (AUadapt) from InfluenzaA__ABI30447__NA

SEQ ID NO: 17774 - RNA, 1410 nt, Artificial Sequence; identical to SEQ ID NO: 16729
  derived and/or modified CDS sequence (AUadapt) from InfluenzaA__ABI30458__NA

SEQ ID NO: 17775 - RNA, 1410 nt, Artificial Sequence; identical to SEQ ID NO: 16729
  derived and/or modified CDS sequence (AUadapt) from InfluenzaA__ABI30469__NA

SEQ ID NO: 17776 - RNA, 1410 nt, Artificial Sequence; identical to SEQ ID NO: 16729
  derived and/or modified CDS sequence (AUadapt) from InfluenzaA__ABI30480__NA

SEQ ID NO: 17777 - RNA, 1410 nt, Artificial Sequence
  derived and/or modified CDS sequence (AUadapt) from InfluenzaA__ABI30491__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccaagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 17778 - RNA, 1410 nt, Artificial Sequence; identical to SEQ ID NO: 16729
  derived and/or modified CDS sequence (AUadapt) from InfluenzaA__ABI30502__NA

SEQ ID NO: 17779 - RNA, 1410 nt, Artificial Sequence
  derived and/or modified CDS sequence (AUadapt) from InfluenzaA__ABI30513__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 17780 - RNA, 1410 nt, Artificial Sequence; identical to SEQ ID NO: 16729
  derived and/or modified CDS sequence (AUadapt) from InfluenzaA__ABI30524__NA

SEQ ID NO: 17781 - RNA, 1410 nt, Artificial Sequence; identical to SEQ ID NO: 16729
  derived and/or modified CDS sequence (AUadapt) from InfluenzaA__ABI30535__NA

SEQ ID NO: 17782 - RNA, 1410 nt, Artificial Sequence
  derived and/or modified CDS sequence (AUadapt) from InfluenzaA__ABI30546__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaaccugcacuccaacgacaccgugcacgaccgcaccccguaccggacccuccugaugagcgagcugggcguccccuuccaccucggcacgaagcaggucugcaucgccugguccucguccagcugccacgacgggaaggccuggaugcacgugugcgugaccggcgacgacaagaacgcgaccgccuccuucaucuacaacgggcgccugguggacagcaucguguccuggucgaaggagauccugcggacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcucgugcuacccccgcuaccccggcgugcggugcgucugccgcgacaacuggaagggguccaaccggccgaucguggacaucaacaucaaggacuacagcaucguguccucguacgucugcuccggccuggugggcgacacgccccgcaagaacgacagcuccagcuccucgcacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacucgaagcugcagaucaaccggcaggucaucguggaccgcggcaaccgguccggguacagcggcaucuucucgguggaggggaagaacugcaucaaccgcugcuucuacgucgagcucauccggggccgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 17783 - RNA, 1410 nt, Artificial Sequence; identical to SEQ ID NO: 16729
  derived and/or modified CDS sequence (AUadapt) from InfluenzaA__ABI30557__NA

SEQ ID NO: 17784 - RNA, 1410 nt, Artificial Sequence; identical to SEQ ID NO: 17116
  derived and/or modified CDS sequence (AUadapt) from InfluenzaA__ABI30579__NA

SEQ ID NO: 17785 - RNA, 1410 nt, Artificial Sequence
  derived and/or modified CDS sequence (AUadapt) from InfluenzaA__ABI30590__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggucgaaccccaacuccaagcugcagaucaaccgccaggugaucguggaccggggcaaccggagcggguacuccggcaucuucucggucgaggggaagggcugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 17786 - RNA, 1410 nt, Artificial Sequence; identical to SEQ ID NO: 17209
  derived and/or modified CDS sequence (AUadapt) from InfluenzaA__ABI30601__NA

SEQ ID NO: 17787 - RNA, 1410 nt, Artificial Sequence
  derived and/or modified CDS sequence (AUadapt) from InfluenzaA__ABI30612__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucauccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 17788 - RNA, 1410 nt, Artificial Sequence; identical to SEQ ID NO: 17209
  derived and/or modified CDS sequence (AUadapt) from InfluenzaA__ABI30623__NA

SEQ ID NO: 17789 - RNA, 1410 nt, Artificial Sequence
  derived and/or modified CDS sequence (AUadapt) from InfluenzaA__ABI30736__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccgucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 17790 - RNA, 1410 nt, Artificial Sequence
  derived and/or modified CDS sequence (AUadapt) from InfluenzaA__ABI30758__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcuguacgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 17791 - RNA, 1410 nt, Artificial Sequence; identical to SEQ ID NO: 17116
  derived and/or modified CDS sequence (AUadapt) from InfluenzaA__ABI30769__NA

SEQ ID NO: 17792 - RNA, 1410 nt, Artificial Sequence; identical to SEQ ID NO: 17116
  derived and/or modified CDS sequence (AUadapt) from InfluenzaA__ABI30780__NA

SEQ ID NO: 17793 - RNA, 1410 nt, Artificial Sequence; identical to SEQ ID NO: 17116
  derived and/or modified CDS sequence (AUadapt) from InfluenzaA__ABI30791__NA

SEQ ID NO: 17794 - RNA, 1410 nt, Artificial Sequence; identical to SEQ ID NO: 17116
  derived and/or modified CDS sequence (AUadapt) from InfluenzaA__ABI30802__NA

SEQ ID NO: 17795 - RNA, 1410 nt, Artificial Sequence; identical to SEQ ID NO: 17116
  derived and/or modified CDS sequence (AUadapt) from InfluenzaA__ABI30813__NA

SEQ ID NO: 17796 - RNA, 1410 nt, Artificial Sequence; identical to SEQ ID NO: 17116
  derived and/or modified CDS sequence (AUadapt) from InfluenzaA__ABI30824__NA

SEQ ID NO: 17797 - RNA, 1410 nt, Artificial Sequence; identical to SEQ ID NO: 17116
  derived and/or modified CDS sequence (AUadapt) from InfluenzaA__ABI30835__NA

SEQ ID NO: 17798 - RNA, 1410 nt, Artificial Sequence; identical to SEQ ID NO: 17116
  derived and/or modified CDS sequence (AUadapt) from InfluenzaA__ABI30846__NA

SEQ ID NO: 17799 - RNA, 1410 nt, Artificial Sequence; identical to SEQ ID NO: 17587
  derived and/or modified CDS sequence (AUadapt) from InfluenzaA__ABI30857__NA

SEQ ID NO: 17800 - RNA, 1410 nt, Artificial Sequence; identical to SEQ ID NO: 17587
  derived and/or modified CDS sequence (AUadapt) from InfluenzaA__ABI30868__NA

SEQ ID NO: 17801 - RNA, 1350 nt, Artificial Sequence
  derived and/or modified CDS sequence (AUadapt) from InfluenzaA__ABI36157__NA
augaaucccaaccagaagaucaucaccaucggcucgaucugcauggccaucgggaccgugucccugaugcuccagaucggcaacaugaucagcaucugggucucccauagcauccagacggggaaccagcaccaggccgaguccaucagcaacaccaacccgcugaccgagaaggcgguggccuccgugacccuggccggcaauagcucccucugccccauccgcgggugggccguccacagcaaggacaacuccauccggaucggcaguaagggcgacguguucgugauccgcgagcccuucaucuccugcagccacuccgagugucggacguucuuccugacccagggggcccugcucaacgacaagcacagcaaugagaccgucaaggaccgcagcccccaccggacccugaugagcugcccggugggcgaggcgcccucccccuauaacagccgcuucgagagcguggccugguccgccagcgccugccaugacgggacguccuggcugaccaucggcaucagcgggcccgacaacggcgcggucgccgugcucaaguacaacggcaucaucaccgauaccaucaaguccuggcggaacaacauccugcgcacgcaggagucggagugcgccugcgugaacggguccuguuucaccgucaugaccgacggcccgagcaacgggcaggccuccuacaagaucuucaagauggagaagggcaagguggugaaguccgucgagcuggaugcccccaacuaccacuacgaggagugcuccuguuaccccgacgcgggcgagaucacgugcgugugccgggacaacuggcaugggagcaaccgccccuggguguccuucaaccagaaccucgaguaccagaucggcuauaucugcagcggggucuucggcgacaacccgcggcccaacgaugggaccggcuccugcggccccaugagcuccaacggggccuacggcgugaagggguucagcuuuaaguacggcaacgggguguggaucggccgcaccaaguccaccaacagccggagcggcuuugagaugaucugggaccccaacggguggaccggcacggacuccagcuucuccgucaagcaggacaucguggccaucaccgauuggagcggguacuccggcagcuucgugcagcacccggagcugaccgggcuggacuguauccgccccugcuucugggucgagcucauccggggccgccccaaggaguccaccaucuggacgagcggcuccagcaucuccuucugcggggugaauagcgacaccgucuccuggagcuggcccgacggcgccgagcugccguucaccaucgacaaguga

SEQ ID NO: 17802 - RNA, 1350 nt, Artificial Sequence; identical to SEQ ID NO: 17801
  derived and/or modified CDS sequence (AUadapt) from InfluenzaA__ABI36168__NA

SEQ ID NO: 17803 - RNA, 1350 nt, Artificial Sequence; identical to SEQ ID NO: 17801
  derived and/or modified CDS sequence (AUadapt) from InfluenzaA__ABI36179__NA

SEQ ID NO: 17804 - RNA, 1350 nt, Artificial Sequence; identical to SEQ ID NO: 17801
  derived and/or modified CDS sequence (AUadapt) from InfluenzaA__ABI36189__NA

SEQ ID NO: 17805 - RNA, 1350 nt, Artificial Sequence
  derived and/or modified CDS sequence (AUadapt) from InfluenzaA__ABI36278__NA
augaaucccaaccagaagaucaucaccaucggcucgaucugcauggugaucgggaucgucucccugaugcuccagaucggcaacaugaucagcaucugggugucccacaguauccagaaggggaaccagcaccaggccgaguccaucagcaacaccaacccgcugacggagaaggccguggcguccgucacccuggccggcaacagcucccucugucccauccgcgggugggccgugcacagcaaggacaacaacauccggaucggcuccaagggcgacguguucgucauccgcgagcccuuuaucagcugcucccaccuggagugccggaccuucuuccugacccagggggcccuccugaacgauaagcacagcaacggcacggugaaggaccgcagcccccaccggacccugauguccugcccggugggggaggcccccucccccuauaacucgcgcuucgaguccgucgcguggagcgccagcgccugccacgauggcaccuccuggcucaccaucgggaucagcggccccgacaacgaggccguggcggugcugaaguacaacggcaucaucacggacaccaucaaguccuggcggaacaauauccugcgcacccaggagagcgagugcgccugcgucaacggguccugcuucaccgugaugacggacggcccgaguaacgggcaggccuccuacaagaucuucaagauggagaagggcaagguggucaagagcguggagcucgacgcccccaacuaccauuacgaggagugcuccugcuaccccgacgccggcgagaucacgugcgugugccgggauaacuggcacgggagcaaccgccccugggucuccuucaaccagaaccuggaguaucagaucggcuacaucugcagcgggguguucggcgacaacccgcggcccaacgaugggaccggcuccugcggccccaugucgcccaacggggcguacggcgugaagggguucuccuucaaguacggcaauggggucuggaucggccgcaccaagagcaccaacucccggagcggcuucgagaugaucugggacccgaacggguggaccggcaccgacuccaguuucagcgugaagcaggacaucguggccaucaccgacugguccggguacagcggcuccuucguccagcaucccgagcugacggggcucgacugcauccgccccugcuucuggguggagcugauccggggccgccccaaggagagcaccaucuggaccuccggcagcuccaucagcuuuugcggggucaacuccgacaccgugagcugguccuggccggacggcgccgagcugcccuucacgaucgacaaguga

SEQ ID NO: 17806 - RNA, 1350 nt, Artificial Sequence; identical to SEQ ID NO: 17805
  derived and/or modified CDS sequence (AUadapt) from InfluenzaA__ABI36287__NA

SEQ ID NO: 17807 - RNA, 1350 nt, Artificial Sequence; identical to SEQ ID NO: 17805
  derived and/or modified CDS sequence (AUadapt) from InfluenzaA__ABI36298__NA

SEQ ID NO: 17808 - RNA, 1350 nt, Artificial Sequence
  derived and/or modified CDS sequence (AUadapt) from InfluenzaA__ABI36314__NA
augaaucccaaccagaagaucaucaccaucggcucgaucugcauggugaucgggaucgucucccugaugcuccagaucggcaacaugaucagcaucugggugucccacagcauccagaccgggaaucagcaccaggccgaguccaucagcaacacgaacccgcugaccgagaaggccguggcguccgucacccuggccggcaacagcucccucugccccauccgcgggugggccgugcauagcaaggacaacaacauccggaucggcuccaagggcgacguguucgucauccgcgagcccuucaucaguugcucccaccuggagugccggaccuucuuccugacgcagggggcccuccugaacgacaagcauagcaacggcaccgugaaggaccgcagcccccaccggacccugauguccugcccggugggggaggcccccucccccuacaauucgcgcuucgaguccgucgcguggagcgccagcgccugccacgacggcaauuccuggcucaccaucgggaucagcggccccgacaacgaggccguggcggugcugaaguacaacggcaucaucacggacaccaucaaguccuggcggaacaauauccugcgcacccaggagagcgagugcgccugcgucaacggguccugcuucaccgugaugacggacggcccgaguaacgggcaggccuccuacaagaucuucaagauggagaagggcaagguggucaagagcguggagcucgacgcccccaacuaccauuacgaggagugcuccugcuaccccgacgccggcgagaucacgugcgugugccgggauaacuggcacgggagcaaccgccccugggucuccuucaaccagaaccuggaguaucagaucggcuacaucugcagcgggguguucggcgacaacccgcggcccaacgaugggaccggcuccugcggccccaugucgcccaacggggcguacggcgugaagggguucuccuucaaguacggcaauggggucuggaucggccgcaccaagagcaccaacucccggagcggcuucgagaugaucugggacccgaacggguggaccggcaccgacuccaguuucagcgugaagcaggacaucguggccaucaccgacugguccggguacagcggcuccuucguccagcaucccgagcugacggggcucgacugcauccgccccugcuucuggguggagcugauccggggccgccccaaggagagcaccaucuggaccuccggcagcuccaucagcuuuugcggggucaacuccgacaccgugagcugguccuggccggacggcgccgagcugcccuucacgaucgacaaguga

SEQ ID NO: 17809 - RNA, 1350 nt, Artificial Sequence
  derived and/or modified CDS sequence (AUadapt) from InfluenzaA__ABI36336__NA
augaaucccaaccagaagaucaucaccaucggcucgaucugcauggugaucgggaucgucucccugaugcuccagaucggcaacaugaucagcaucugggugucccacagugugcagaccgggaaccagcaccaggccgaguccaucagcaacacgaacccgcugaccgagaaggccgucgcguccgugacccuggccggcaacagcucccucugucccauccgcgggugggccgugcacagcaaggacaacaacauccggaucggcuccaagggcgacgucuucgugauccgcgagcccuuuaucagcugcucccaccuggagugccggaccuucuuccugacgcagggggcccuccugaacgauaagcacagcaacggcaccgugaaggaccgcagcccccaccggacccugauguccugcccgcucggggaggcccccucccccuauaacagccgcuucgaguccgucagcuggagcgcguccgccugccacgauggcaccagcuggcugacgaucgggaucuccggccccgacaacgaggccguggccgugcugaaguacaacggcaucaucaccgacaccaucaagagcuggcggaauaacauccuccgcacccaggaguccgagugcgcgugcgucaacgggucgugcuucacggugaugaccgauggcccguccaacgggcaggccagcuacaagaucuucaagauggagaagggcaagguggucaaguccguggagcuggacgcccccaacuaccauuacgaggagugcagcugcuaccccgacgccggcgagaucacgugcgugugucgggacaacuggcacggguccaaccgccccugggucagcuucaaccagaaucuggaguaccagaucggcuacaucugcuccgggguguucggcgacaacccgcggcccaacgaugggaccggcagcugcggccccaugucccccaacggggccuacggcgugaagggguucagcuucaaguauggcaacggggucuggaucggccgcaccaaguccaccaacagccgguccggcuucgagaugaucugggacccgaacggguggaccggcaccgacaguagcuucuccgugaagcaggacaucguggcgaucacggacuggagcggguacuccggcagcuuuguccagcaccccgagcucaccgggcuggacugcauccgccccugcuucuggguggagcugauccggggccgccccaaggaguccaccaucuggaccagcggcuccaucaucagcuuuugcggggucaacuccgacacggugagcugguccuggccggacggcgccgagcuccccuucaccaucgacaaguga

SEQ ID NO: 17810 - RNA, 1350 nt, Artificial Sequence
  derived and/or modified CDS sequence (AUadapt) from InfluenzaA__ABI36358__NA
augaaucccaaccagaagaucaucaccaucggcucgaucugcauggugaucgggaucgucucccugaugcuccagaucggcaacaugaucagcaucugggugucccacagugugcagaccgggaaccagcaccaggccgaguccaucagcaacacgaacccgcugaccgagaaggccgucgcguccgugacccuggccggcaacaguucccucugccccauccgcgggugggccgugcacagcaaggacaacaacauccggaucggcuccaagggcgaugucuucgugauccgcgagcccuucaucagcugcucccaccuggagugccggaccuuuuuccugacgcagggggcccuccugaacgacaagcacagcaacggcaccgugaaggaucgcagcccccaccggacccugaugagcugcccggucggggaggcccccucccccuacaacagucgcuucgaguccguggcguggagcgccagcgccugccacgacggcaccuccuggcucacgaucgggaucaguggccccgacaacgaggccguggcgguccugaaguacaacggcaucaucaccgacaccaucaaguccuggcggaacaauauccugcgcacccaggagagcgagugcgccugcgugaacggguccugcuucacggugaugaccgauggcccgagcaacgggcaggccuccuacaagaucuucaagauggagaagggcaaggucgugaaguccguggagcucgacgcccccaacuaccauuacgaggagugcuccugcuaccccgacgccggcgagaucacgugcgucugucgggacaacuggcacgggagcaaccgccccuggguguccuucaaucagaaccuggaguaccagaucggcuacaucugcagcgggguguucggcgauaacccgcggcccaacgacgggaccggcuccugcggccccaugagccccaacggggcguauggcgucaagggguucuccuucaaguacggcaacgggguguggaucggccgcaccaagagcaccaacucccggaguggcuucgagaugaucugggacccgaacggguggaccggcaccgacuccagcuucagugugaagcaggacaucgucgccaucacggacugguccggguacagcggcuccuucgugcagcaccccgagcugaccgggcucgauugcauccgccccugcuucugggucgagcugauccggggccgccccaaggagagcaccaucuggaccuccggcagcuccaucagcuuuugcggggugaacuccgacacggugagcugguccuggccggacggcgccgagcugcccuucaccaucgacaaguga

SEQ ID NO: 17811 - RNA, 1350 nt, Artificial Sequence; identical to SEQ ID NO: 17801
  derived and/or modified CDS sequence (AUadapt) from InfluenzaA__ABI36369__NA

SEQ ID NO: 17812 - RNA, 1350 nt, Artificial Sequence
  derived and/or modified CDS sequence (AUadapt) from InfluenzaA__ABI36391__NA
augaaucccaaccagaagaucaucaccaucggcucgaucugcauggugaucgggaucgucucccugaugcuccagaucggcaacaugaucagcaucugggugucccacagcacccagaaggggaaucagcaccaggccgaguccaucagcaacacgaacccgcugaccgagaaggccguggcguccgucacccuggccggcaacagcucccucugccccauccgcgggugggccgugcacaguaaggacaacaacauccggaucggcuccaagggcgacguguucgucauccgcgagcccuucaucagcuguucccaccuggagugccggaccuucuuccugacgcagggggcccuccugaacgacaagcacucgaauggcaccgugaaggaccgcagcccccaccggacccugauguccugcccggugggggaggcccccucccccuacaacagccgcuuugaguccgucgcguggagcgccagcgccugccacgacggcaccuccuggcucacgaucgggaucagcggccccgacaacgaggccguggcggugcugaaguauaacggcaucaucaccgacaccaucaaguccuggcggaacaacauccugcgcacccaggagagcgagugcgccugcgucaauggguccugcuucacggugaugaccgacggcccgucgaacgggcaggccuccuacaagaucuucaagauggagaagggcaagguggucaagagcguggagcucgaugcccccaacuaccacuacgaggagugcuccugcuaccccgaugccggcgagaucacgugcgugugccgggacaacuggcacgggagcaaccgccccugggucuccuucaaucagaaccuggaguaccagaucggcuacaucugcagcgggaucuucggcgacaauccgcggcccaacgacgggaccggcuccugcggccccauguuccccaacggggcguacggcgugaagggguucagcuuuaaguacggcaacgggguguggaucggccgcaccaaguccaccaacagccgguccggcuucgagaugaucugggacccgaacggguggaccggcaccgauagcuccuucucggucaagcaggacaucguggccaucacggacuggagcggguacuccggcagcuuugugcagcaccccgagcugaccgggcucgacugcauccgccccugcuucugggucgagcugauccggggccgccccaaggaguccaccaucuggaccagcggcuccagcaucuccuuuugcggggugaacagcgacacggucuccuggagcuggccggacggcgccgagcugcccuucaccaucgacaaguga

SEQ ID NO: 17813 - RNA, 1350 nt, Artificial Sequence; identical to SEQ ID NO: 17812
  derived and/or modified CDS sequence (AUadapt) from InfluenzaA__ABI36402__NA

SEQ ID NO: 17814 - RNA, 1350 nt, Artificial Sequence; identical to SEQ ID NO: 17801
  derived and/or modified CDS sequence (AUadapt) from InfluenzaA__ABI36413__NA

SEQ ID NO: 17815 - RNA, 1350 nt, Artificial Sequence
  derived and/or modified CDS sequence (AUadapt) from InfluenzaA__ABI36446__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggcguccgucacccuggccggcaacagcucccucugucccauccgcgggugggccgugcacagcaaggacaacaacauccggaucggcuccaagggcgacguguucgucauccgcgagcccuuuaucagcugcucccaccuggagugccggaccuucuuccugacgcagggggcccuccugaacgauaagcacagcaacggcaccgugaaggaccgcagcccccaccggacccugauguccugcccggugggggaggcccccucccccuauaacucgcgcuucgaguccgucgcguggagcgccagcgccugccacgauggcaccuccuggcucacgaucgggaucagcggccccgacaacgaggccguggcggugcugaaguacaacggcaucaucaccgacaccaucaaguccuggcggaacaauauccugcgcacccaggagagcgagugcgccugcgucaacggguccugcuucacggugaugaccgacggcccgaguaacgggcaggccuccuacaagaucuucaagauggagaagggcaagguggucaagagcguggagcucgacgcccccaacuaccauuacgaggagugcuccugcuaccccgacgccggcgagaucacgugcgugugccgggauaacuggcacgggagcaaccgccccuggaucuccuucaaccagaaccuggaguaucagaucggcuacaucugcagcggggucuucggcgacaacccgcggcccaacgaugggaccggcuccugcggccccaugucgcccaacggggcguacggcgugaagggguucuccuucaaguacggcaaugggguguggaucggccgcaccaagagcaccaacucccggagcggcuucgagaugaucugggacccgaacggguggaccggcaccgacuccaguuucagcgucaagcaggacaucguggccaucacggacugguccggguacagcggcuccuucgugcagcaucccgagcugaccgggcucgacugcauccgccccugcuucugggucgagcugauccggggccgccccaaggagagcaccaucuggaccuccggcagcuccaucagcuuuugcggggugaacuccgacacggucagcugguccuggccggacggcgccgagcugcccuucaccaucgacaaguga

SEQ ID NO: 17816 - RNA, 1350 nt, Artificial Sequence; identical to SEQ ID NO: 17805
  derived and/or modified CDS sequence (AUadapt) from InfluenzaA__ABI36457__NA

SEQ ID NO: 17817 - RNA, 1350 nt, Artificial Sequence
  derived and/or modified CDS sequence (AUadapt) from InfluenzaA__ABI36476__NA
augaaucccaaccagaagaucaucaccaucggcucgaucugcauggugaucgggaucgucucccugaugcuccagaucggcaacaugaucagcaucugggugucccacaguacccagaaggggaaccagcaccaggccgaguccaucagcaacacgaacccgcugaccgagaaggccguggcguccgucacccuggccggcaacagcucccucugucccauccgcgggugggccgugcacagcaaggacaacaacauccggaucggcuccaagggcgacguguuugucauccgcgagcccuucaucagcugcucccaccuggagugccggaccuucuuccugacgcagggggcccuccugaaugacaagcacagcaacggcaccgugaaggaccgcagcccccaucggacccugauguccugcccggugggggaggcccccucccccuacaacucgcgcuucgaguccgucgcguggagcgccagcgccugucacgacggcaccuccuggcucacgaucgggaucagcggccccgacaacgaggccguggcggugcugaaguacaauggcaucaucaccgacaccaucaaguccuggcggaacaacauccugcgcacccaggagagcgagugcgccugcgucaacggguccuguuucacggugaugaccgacggcccgagcaacgggcaggccuccuacaagaucuucaagauggagaagggcaagguggucaagaguguggagcucgacgcccccaacuaccacuacgaggagugcuccugcuaucccgacgccggcgagaucacgugcgugugccgggacaacuggcacgggaguaaccgccccugggucuccuucaaccagaaccuggaguaccagaucggcuacaucugcagugggguguucggcgacaacccgcggcccaacgacgggaccggcuccugcggccccaugagucccaacggggcguacggcgugaagggguucuccuucaaguacggcaacggggucuggaucggccgcaccaagagcaccaauucccggagcggcuucgagaugaucugggacccgaacggguggaccggcaccgacuccagcuuuagcgugaagcaggacaucguggccaucacggacugguccggguacagcggcuccuucguccagcaccccgagcugaccgggcucgauugcauccgccccugcuucuggguggagcugauccggggccgccccaaggagagcaccaucuggaccuccggcagcuccaucagcuuuugcggggucaacuccgacacggugagcugguccuggccggacggcgccgagcugcccuucaccaucgacaaguga

SEQ ID NO: 17818 - RNA, 1350 nt, Artificial Sequence
  derived and/or modified CDS sequence (AUadapt) from InfluenzaA__ABI49409__NA
augaaucccaaccgcaagaucaucaccaucggcagcaucugcauggugaucgggauggucucccugaugcuccagaucggcaacaugaucagcaucugggugucccauagcauccagaccgggaaccagcaccaggccgaguccaucagcaacacgaacccgcugaccgagaaggccguggcguccgucacccuggccggcaauagcucccucugccccauccgggggugggccgugcacagcaaggacaacaauauccgcaucggcuccaagggcgacguguucgucauccgggagcccuucaucagcugcucccaucuggagugccgcaccuucuuccugacgcagggggcccuccugaacgacaagcacaguaacggcaccgugaaggaccggagcccccaccgcacccugauguccugcccggugggggaggcccccucccccuacaauagccgguucgaguccgucgcguggagcgccagcgccugccaugacggcaccuccuggcucacgaucgggaucagcggccccgacaacgaggccguggcggugcugaaguacaacggcaucaucaccgauaccaucaaguccuggcgcaacaacauccugcggacccaggagagcgagugcgccugcgucaacggguccuguuucacggugaugaccgacggcccgagcaacgggcaggccuccuacaagaucuucaagauggagaagggcaagguggucaagaguguggagcucguggcccccaacuaccacuacgaggagugcuccuguuaccccgacgccggcgagaucacgugcgucugccgcgacaacuggcaugggagcaaccggcccuggguguccuucaaccagaaccuggaguaccagaucggcuauaucugcagcgggguguucggcgacaacccgcgccccaaugacgggaccggcuccugcggccccaugagccccaacggggcguacggcgucaagggguucuccuuuaaguacggcaacgggguguggaucggccggaccaagagcaccaacucccgcagcggcuucgagaugaucugggauccgaacggguggaccggcaccgacuccagcuucagcgugaagcaggauaucgucgccaucacggacugguccggguacagcggcuccuucgugcagcaccccgagcugaccgggcucgacuguauccggcccugcuucugggucgagcugauccgcggccggcccaaggagagcaccaucuggaccuccggcagcuccaucagcuucuguggggugaacuccgacacggccagcugguccuggccggacggcgccgagcugcccuucaccaucgacaaguga

SEQ ID NO: 17819 - RNA, 1350 nt, Artificial Sequence
  derived and/or modified CDS sequence (AUadapt) from InfluenzaA__ABI49417__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggcguccgucacccuggccggcaacagcucccucugucccauccgcgggugggccgugcacagcaaggacaacaacauccggaucggcuccaagggcgacguguuugucauccgcgagcccuucaucagcugcucccaccuggagugccggaccuucuuccugacgcgcggggcccuccugaaugacaagcacagcaacggcaccgugaaggaccggagcccccaucgcacccugauguccugcccggugggggaggcccccucccccuacaacagccgguucgaguccgucgcguggagcgccagcgccugucacgacggcaccuccuggcucacgaucgggaucagcggccccgacaacgaggccguggcggugcugaaguacaauggcaucaucaccgacaccaucaaguccuggcgcaacaacauccugcggacccaggagagcgagugcgccugcgucaacggguccuguuucacggugaugaccgacggcccgucgaacgggcaggccuccuacaagaucuucaagauggagaagggcaagguggucaagaguguggagcucgacgcccccaacuaccacuacgaggagugcuccugcuaucccgacgccggcgagaucacgugcgugugccgcgacaacuggcacgggaguaaccggcccugggucuccuucaaccagaaccuggaguaccagaucggcuacaucugcagugggguguucggcgacaacccgcgccccaacgacgggaccggcuccugcggccccaugagucccaacggggcguacggcgugaagggguucuccuucaaguacggcaacggggucuggaucggccggaccaagagcaccaauucccgcagcggcuucgagaugaucugggacccgaacggguggaccggcaccgacuccagcuuuagcgugaagcaggacaucguggccaucacggacugguccggguacagcggcuccuucguccagcaccccgagcugaccgggcucgauugcauccggcccugcuucuggguggagcugauccgcggccagcccaaggagagcaccaucuggaccuccggcagcuccaucagcuuuugcggggucaacuccgacacggugagcugguccuggccggacggcgccgagcugcccuucaccaucgacaaguga

SEQ ID NO: 17820 - RNA, 1410 nt, Artificial Sequence
  derived and/or modified CDS sequence (AUadapt) from InfluenzaA__ABI84962__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccucguccugccacgacgggaaggccuggcugcacgugugcgucaccggcgacgaccgcaacgccaccgccucguucaucuacgacgggcggcucguggacuccaucggcagcuggucccagaacauccugcgcacgcaggagucggagugcgugugcaucaacgggaccugcaccgucgugaugaccgacggcuccgcgucgggccgggccgacacgcgcauccuguucaucaaggaggggaagaucgugcacaucagcccccucuccggcucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcucggggcuggucggcgacacgccccggaacgacgacuccagcuccaacucgaacugccgcgaccccaacaacgagcgggggaacccgggcgugaaggggugggccuucgacaacggcgacgacguguggaugggccgcaccaucuccaaggacucgcgguccggguacgagaccuucaaggucaucggcggguggagcacccccaacuccaagucgcaggugaaccgccaggucaucguggacaacaacaacugguccggcuacucggggaucuucagcguggagggcaaguccugcaucaaccggugcuucuacgucgagcugauccgcggccgcccccaggagacccgggugugguggaccucgaacuccaucguggucuucugcgggaccagcggcacguacgggaccggcuccuggcccgacggggccaacaucaacuucaugccgaucuga

SEQ ID NO: 17821 - RNA, 1410 nt, Artificial Sequence
  derived and/or modified CDS sequence (AUadapt) from InfluenzaA__ABI85003__NA
augaaccccaaccagaagaucaucaccaucggcguggucaacaccacgcugucgaccaucgcccuccugaucggggugggcaaccugguguucaacaccgucauccacgagaagaucggggaccaccagaucgugacccacccgacgaucaugacccccgaggugcccaacugcuccgacaccaucaucaccuacaacaacacggucaucaacaacaucaccaccaccaucaucacggaggccgagcgccccuucaagucgccgcucccccugugccccuuccggggcuucuuccccuuccacaaggacaacgcgauccgccugggggagaacaaggacgugaucgugacccgggagccguacgucuccugcgacaacgacaacugcuggucguucgcccucgcccagggcgcccugcugggcaccaagcacuccaacgggaccaucaaggaccgcacgcccuaccggucgcucauccgcuuccccaucggcaccgcccccgugcuggggaacuacaaggagaucugcaucgcgugguccagcuccucgugcuucgacggcaaggaguggaugcacgugugcaugaccgggaacgacaacgacgccuccgcccagaucaucuacggcggccggaugaccgacucgaucaaguccuggcgcaaggacauccugcggacgcaggagucggagugccagugcaucgacgggaccugcgucguggccgugaccgacggcccggcggccaacuccgccgaccaccgcgucuacuggauccgggaggggcgcaucaucaaguacgagaacgugcccaagaccaagauccagcaccucgaggagugcucgugcuacguggacaucgacgucuacugcaucugccgggacaacuggaagggcuccaaccgccccuggaugcggaucaacaacgagacgauccuggagaccggcuacgugugcagcaaguuccacuccgacacgccccgcccggccgaccccucgaucaugucgugcgacucccccucgaacgugaacgggggccccggggucaagggcuucggguucaaggccggcaacgacguguggcugggccggaccguguccaccucggggcgcuccggcuucgagaucaucaaggucaccgagggguggaucaacagcccgaaccacgugaaguccaucacccagacccucgucucgaacaacgacugguccggcuacucgggguccuucaucgugaaggcgaaggacugcuuccagcccugcuucuacguggagcugauccggggccgccccaacaagaacgacgacgucucguggacguccaacucgaucgugaccuucugcggccuggacaacgagcccggguccggcaacuggccggacgggagcaacaucggcuucaugcccaaguga

SEQ ID NO: 17822 - RNA, 1410 nt, Artificial Sequence; identical to SEQ ID NO: 17492
  derived and/or modified CDS sequence (AUadapt) from InfluenzaA__ABI92294__NA

SEQ ID NO: 17823 - RNA, 1413 nt, Artificial Sequence
  derived and/or modified CDS sequence (AUadapt) from InfluenzaA__ABI92305__NA
augaaccccaaccagaagaucaucaccaucggcucgaucugcauggccaucgggaucaucucccugauccuccagaucggcaacaucaucagcaucugggugucccaccugauccagaccgggucgcagaaccacacgggcaucugcaaccagcgcaucaucaccuacgagaacuccaccugggucaaccagaccuacgugaacaucaacaacacgaacguggucgccgggaaggacaccaccagcgugacccuggcgggcaacuccucgcucugcccggugcggggcugggccaucuacuccaaggacaacagcauccgcaucggguccaagggcgacgucuucgugauccgggagcccuucaucagcugcucccaccuggagugccgcacguucuuccugacccagggggcccuccugaacgacaagcacucgaacggcaccgugaaggaccggucccccuaccgcgcccugaugagcugccccaucggggaggccccgucccccuacaacucgcgguucgaguccgucgcguggagcgccucggccugccacgacggcaugggcuggcucaccaucgggaucuccggccccgacgacggggccguggcggugcugaaguacaacggcaucaucacggagaccaucaagagcuggcgcaagcggauccugcgcacccaggaguccgagugcgucugcaucaacggcagcugcuucaccaucaugacggacgggcccuccaacggcccggccucguaccggaucuucaagaucgagaaggggaagaucaccaaguccaucgagcucgacgcccccaacagccacuacgaggagugcuccugcuaccccgacaccggcaccgugaugugcgugugccgcgacaacuggcacgggucgaaccggcccugggucuccuucaaccagaaccuggacuaccagaucggcuacaucugcagcggcguguucggggacaacccgcgccccaaggacggcaagggguccugcggccccgugacggucgacggggccgacggcgugaagggcuucucguaccgguacgggaacggcguguggaucgggcgcaccaaguccaacagcucccggaagggcuucgagaugaucugggaccccaacggguggaccgacaccgacagcaacuuccuggucaagcaggacgugguggccaugacggacugguccggcuacucgggcagcuucguccagcacccggagcucaccgggcuggacugcaugcgccccugcuucuggguggagcugauccggggccgcccccgggagaagaccaccaucuggacguccgggucguccaucagcuucugcggcgucaacuccgacaccgugaacuggagcuggcccgacggcgcggagcucccguucaccaucgacaaguga

SEQ ID NO: 17824 - RNA, 1413 nt, Artificial Sequence
  derived and/or modified CDS sequence (AUadapt) from InfluenzaA__ABI92316__NA
augaaccccaaccagaagaucaucaccaucggcucgaucuccaucgccaucggggugaucucgcugauccuccagaucggcaacaucaucuccaucugggccagccacuccauccagaccgggucgcagaaccacacgggcaucugcaaccagcgcaucaucaccuacgagaacuccaccugggucaaccagaccuacgugaacaucaacaacacgaacguggucgcggggaaggacaagaccagcaugacccuggccggcaacuccucgcugugcccgauccggggcugggccaucuacaccaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugcccccugggggaggcgccgucgcccuacaacucccgguucgagagcguggccuggucggccuccgccugccacgacggccucggcuggcugaccaucgggaucagcggccccgacaacggggcgguggccguccugaaguacaacggcaucaucacggagaccaucaaguccuggaagaagcgcauccuccggacccaggagucggagugcgugugcgugaacggcuccugcuucaccaucaugacggacgggcccagcaacggcgccgccuccuaccgcaucuucaagaucgagaaggggcgggucaccaagucgaucgagcuggacgccccgaacuaccacuacgaggagugcuccugcuaccccgacaccggcaccgugaugugcgugugccgcgacaacuggcacgggagcaaccggcccugggucuccuucaaccagaaccuggacuaccagaucggcuacaucugcucgggcguguucggggacaacccccgcccgaaggacggcgagggguccugcaaccccgugacggucgacggcgcggacggggugaagggcuucagcuaccgguacggcaacgggguguggaucggccgcaccaaguccaaccggcuccgcaagggguucgagaugaucugggaccccaacggcuggaccgacaccgacucggacuucuccaugaagcaggacaucgucgccaugacggacuggagcggguacuccggcucguucgugcagcaccccgagcugaccggccuggacugcaugcggccgugcuucuggguggagcucguccgcgggcugccccgggagaacaccaccaucuggacgagcggcuccucgaucuccuucugcggggugaacagcgacaccgccaacugguccuggcccgacggcgccgagcugcccuucaccaucgacaaguga

SEQ ID NO: 17825 - RNA, 1410 nt, Artificial Sequence; identical to SEQ ID NO: 17503
  derived and/or modified CDS sequence (AUadapt) from InfluenzaA__ABI92327__NA

SEQ ID NO: 17826 - RNA, 1410 nt, Artificial Sequence
  derived and/or modified CDS sequence (AUadapt) from InfluenzaA__ABI92338__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucgucaacaucagcacccugucgggguccgcccagcacguggaggagugcucgugcuacccccgguaccccggcgugcgcugcgucugccgggacaacuggaagggcuccaaccgcccgaucaucgacaucaacgugaaggacuacagcaucguguccucguacgucugcuccgggcucgugggcgacacgccccggaagaacgacagcuucuccucgucccacugccuggaccccaacaacgaggagggcggccacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggacgagcaacucgaucguggucuucugcggcaccuccgggaccuacggcaccgggagcuggccggacggcgccgacaucaaccugaugcccaucuga

SEQ ID NO: 17827 - RNA, 1410 nt, Artificial Sequence
  derived and/or modified CDS sequence (AUadapt) from InfluenzaA__ABI92349__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcgaaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggaucgggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17828 - RNA, 1410 nt, Artificial Sequence; identical to SEQ ID NO: 16729
  derived and/or modified CDS sequence (AUadapt) from InfluenzaA__ABI92360__NA

SEQ ID NO: 17829 - RNA, 1410 nt, Artificial Sequence; identical to SEQ ID NO: 16729
  derived and/or modified CDS sequence (AUadapt) from InfluenzaA__ABI92371__NA

SEQ ID NO: 17830 - RNA, 1413 nt, Artificial Sequence; identical to SEQ ID NO: 16788
  derived and/or modified CDS sequence (AUadapt) from InfluenzaA__ABI92382__NA

SEQ ID NO: 17831 - RNA, 1410 nt, Artificial Sequence; identical to SEQ ID NO: 17116
  derived and/or modified CDS sequence (AUadapt) from InfluenzaA__ABI92393__NA

SEQ ID NO: 17832 - RNA, 1410 nt, Artificial Sequence; identical to SEQ ID NO: 16729
  derived and/or modified CDS sequence (AUadapt) from InfluenzaA__ABI92404__NA

SEQ ID NO: 17833 - RNA, 1410 nt, Artificial Sequence
  derived and/or modified CDS sequence (AUadapt) from InfluenzaA__ABI92415__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaacuucaugcccaucuga

SEQ ID NO: 17834 - RNA, 1410 nt, Artificial Sequence; identical to SEQ ID NO: 17116
  derived and/or modified CDS sequence (AUadapt) from InfluenzaA__ABI92426__NA

SEQ ID NO: 17835 - RNA, 1410 nt, Artificial Sequence; identical to SEQ ID NO: 17116
  derived and/or modified CDS sequence (AUadapt) from InfluenzaA__ABI92437__NA

SEQ ID NO: 17836 - RNA, 1410 nt, Artificial Sequence; identical to SEQ ID NO: 17116
  derived and/or modified CDS sequence (AUadapt) from InfluenzaA__ABI92448__NA

SEQ ID NO: 17837 - RNA, 1410 nt, Artificial Sequence; identical to SEQ ID NO: 17116
  derived and/or modified CDS sequence (AUadapt) from InfluenzaA__ABI92459__NA

SEQ ID NO: 17838 - RNA, 1410 nt, Artificial Sequence
  derived and/or modified CDS sequence (AUadapt) from InfluenzaA__ABI92470__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgagaaggcggacaccaagauccuguucaucgaggaggggaagaucguccacacgucgagccuguccggcucggcccagcacguggaggagugcuccugcuacccccgcuaccccggggugcggugcgucugccgcgacaacuggaagggcagcaaccggccgaucguggacaucaacgugaaggacuacuccaucgucucguccuacgugugcagcggccucgugggggacacgccccgcaagaacgacuccucguccucgucccacugccuggaccccaacaacgaggagggcgggcacggcgucaaggggugggccuucgacgacggcaacgacguguggaugggccggaccaucagcgagaagcugcgcuccggguacgagaccuucaaggucaucgagggcuggucgaagcccaacuccaagcuccagaucaaccgccaggugaucguggaccgggggaaccggagcggcuacuccgggaucuucucggucgagagcaaguccugcaucaaccgcugcuucuacguggagcugauccggggccgcaagcaggagaccgaggugcuguggaccucgaacuccaucgucguguucugcggcaccagcgggaccuacggcacgggguccuggccggacggcgccgacaucaaccucaugcccaucuga

SEQ ID NO: 17839 - RNA, 1410 nt, Artificial Sequence; identical to SEQ ID NO: 17132
  derived and/or modified CDS sequence (AUadapt) from InfluenzaA__ABI92481__NA

SEQ ID NO: 17840 - RNA, 1410 nt, Artificial Sequence; identical to SEQ ID NO: 17132
  derived and/or modified CDS sequence (AUadapt) from InfluenzaA__ABI92492__NA

SEQ ID NO: 17841 - RNA, 1410 nt, Artificial Sequence
  derived and/or modified CDS sequence (AUadapt) from InfluenzaA__ABI92503__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggaggaguaccggaacugguccaagccgcagugcaacaucaccggguucgcgcccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggccuggcugcacgugugcgugaccggggacgacgagaacgcgaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggccgacaccaagauccuguucaucgaggagggcaagaucguccacacgucgagccuguccgggucggcgcagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 17842 - RNA, 1410 nt, Artificial Sequence
  derived and/or modified CDS sequence (AUadapt) from InfluenzaA__ABI92514__NA
augaaccccaaccagaagaucaucaccaucggcucggugucccugaccaucgccacgaucugcuuccucguccagaucgccauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaaccgccacagcaacgacaccgugcacgaccggaccccguaccgcacccuccugaugaacgagcugggcgugcccuuccaccucggcacgaagcaggucugcaucgccugguccucguccucgugccacgacgggaaggcguggcugcacgugugcgugaccggcgacgacgagaacgccaccgccuccuucaucuacgacgggcggcuggucgacagcaucggcuccuggucgaagaagauccuccgcacccaggaguccgagugcgugugcaucaacgggacgugcaccguggucaugaccgacggcagcgccuccggccgggcggacaccaagauccuguucaucgaggaggggaagaucgugcacacgucgaagcugucgggcuccgcccagcacguggaggagugcagcugcuacccccgcuaccccgggguccggugcgugugccgcgacaacuggaagggcuccaaccggccgaucguggacaucaacgucaaggacuacucgaucguguccagcuacgugugcuccggccucgucggggacacgccccgcaagaacgacucguccucguccagccacugccuggaccccaacaacgaggagggcgggcacggcgugaaggggugggccuucgacgacggcgacgacgucuggaugggccggaccaucuccgagaagucccgcucgggguacgagaccuucaaggugaucgagggcuggagcaagcccaacuccaagcugcagaucaaccgccaggugaucgucgagcgggggaacaugucgggcuacuccgggaucuucucgguggagggcaagagcugcaucaaccggugcuucuacguggagcucauccgcggccggaagcaggagaccgaggucugguggaccuccaacucgaucgugguguucugcgggaccuccggcaccuacgggacgggcagcuggccggacggggccgacaucaaccugaugcccaucuga

SEQ ID NO: 17843 - RNA, 1410 nt, Artificial Sequence
  derived and/or modified CDS sequence (AUadapt) from InfluenzaA__ABI92525__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggaccuacggcacggggagcuggccggacggcgccgacaucaaccugaugcccaucuga

SEQ ID NO: 17844 - RNA, 1410 nt, Artificial Sequence
  derived and/or modified CDS sequence (AUadapt) from InfluenzaA__ABI92536__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcgccgggagcuggccggacggcgccgacaucaaccugaugcccaucuga

SEQ ID NO: 17845 - RNA, 1410 nt, Artificial Sequence
  derived and/or modified CDS sequence (AUadapt) from InfluenzaA__ABI92547__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcgccgggagcuggccggacggcgccgacaucaaccugaugcccaucuga

SEQ ID NO: 17846 - RNA, 1410 nt, Artificial Sequence
  derived and/or modified CDS sequence (AUadapt) from InfluenzaA__ABI92558__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacuggucccgcccgcagugcaacaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggaccuacggcacggggagcuggccggacggcgccgacaucaaccugaugcccaucuga

SEQ ID NO: 17847 - RNA, 1410 nt, Artificial Sequence
  derived and/or modified CDS sequence (AUadapt) from InfluenzaA__ABI92569__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggcaagcugguggacagcaucggguccuggucgaagaagauccuccggacccaggaguccgagugcgucugcaucaacggcacgugcgccguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagacggaggugugguggaccagcaacucgaucgucguguucugcggcaccuccgggaccuacggcacggggagcuggccggacggcgccgacaucaaccugaugcccaucuga

SEQ ID NO: 17848 - RNA, 1410 nt, Artificial Sequence
  derived and/or modified CDS sequence (AUadapt) from InfluenzaA__ABI92580__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaacaaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggagcggggcaaccgcucgggguacuccggcaucuucagcgucgagggcaaggggugcaucaaccggugcuucuacguggagcugauccgcggccggaaggaggagaccgaggugugguggaccuccaacucgaucgucguguucugcgggaccagcggcaccuacgggacgggcuccuggccggacggcgccgacaucaaccugaugcccaucuga

SEQ ID NO: 17849 - RNA, 1410 nt, Artificial Sequence
  derived and/or modified CDS sequence (AUadapt) from InfluenzaA__ABI92591__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccuccgcacgcgccaggugugcaucgccugguccagcuccucgugccacgacgggaaggcguggcugcacgucugcgugaccggcgacgacgagaacgccaccgccuccuucaucuacaacgggcggcugguggacagcaucggcuccuggucgaagaagauccuccggacccaggaguccgagugcgucugcaucaacgggacgugcaccguggugaugaccgacggcucggccuccggcaaggcggacaccaagauccuguucaucgaggaggggaagaucguccacaucagcacgcugucgggcuccgcccagcacguggaggagugcagcugcuacccccgcuaccccggggugcggugcgucugccgcgacaacuggaagggcuccaaccggccgaucguggacaucaacgugaaggacuacucgaucgucuccucguacgugugcuccggccucgugggggacacgccccgcaagaacgacagccuguccucgucccacugccuggaccccaacaacgaggagggcgggcacggcgucaaggggugggccuucgacgacggcaacgacguguggaugggccggaccaucagcgagaagcuccgcuccggguacgagaccuucaaggucaucgagggcuggucgaagcccaacuccaagcugcagaucaaccgccaggugaucguggagcgggggaaccggucgggcuacuccgggaucuucagcgucgagggcaagggcugcaucaaccgcugcuucuacguggagcugauccgggggcgcaaggaggagaccgaggugugguggaccuccaacucgaucgucguguucugcggcaccagcgggaccuacggcacgggguccuggccggacggcgccgacaucaaccucaugcccaucuga

SEQ ID NO: 17850 - RNA, 1410 nt, Artificial Sequence
  derived and/or modified CDS sequence (AUadapt) from InfluenzaA__ABI92602__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccucccugaucuacaacggccggcucguggacagcaucggguccuggucgaagaagauccugcgcacccaggaguccgagugcgucugcaucaacggcacgugcaccguggugaugaccgacggcagcgccuccgggaaggcggacaccaagauccuguucaucgaggagggcaagaucguccacaucucgacgcucagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcuggugggcgacacgccccggaagaacgacucguucuccagcucccacugccuggaccccaacaacgaggagggcgggcacggggucaagggcugggccuucgacgacggcaacgacguguggauggggcgcaccaucucggagaagcuccgguccggcuacgagaccuucaaggucaucgagggguggucgaagcccaacuccaagcuccaggugaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 17851 - RNA, 1410 nt, Artificial Sequence
  derived and/or modified CDS sequence (AUadapt) from InfluenzaA__ABI92613__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacaacgagaacgccaccgccuccuucaucuacaacggcaagcugguggacagcaucggguccuggucgaagaagauccuccggacccaggaguccgagugcgucugcaucaacggcacgugcgccguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagacggaggugugguggaccagcaacucgaucgucguguucugcggcaccuccgggaccuacggcacggggagcuggccggacggcgccgacaucaaccugaugcccaucuga

SEQ ID NO: 17852 - RNA, 1410 nt, Artificial Sequence
  derived and/or modified CDS sequence (AUadapt) from InfluenzaA__ABI92624__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugauccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgccugguccucguccagcugccacgacggcaaggcguggcugcacgucugcgugacgggggacgacgagaacgccaccgccuccuucaucuacaacggccggcugguggacucgaucggguccuggagcaagaagauccuccgcacccaggaguccgagugcgucugcaucaacgggaccugcacgguggugaugaccgacggcucggccuccgggaaggcggacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggaccacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 17853 - RNA, 1410 nt, Artificial Sequence
  derived and/or modified CDS sequence (AUadapt) from InfluenzaA__ABI92635__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaaccucaccggguucgcccccuucuccaaggacaacagcauccgccuguccgccggcggggacaucugggugacccgggagcccuacgugucgugcgacccggacaagugcuaccaguucgcccugggccaggggaccacgcucaacaacggccacuccaacgacaccguccacgaccgcacccccuaccggacccugcugaugaacgagcucggcgugcccuuccaccuggggacgcgccaggugugcaucgccuggucguccagcuccugccacgacggcaaggcguggcugcacgucugcgugaccggggacgacgagaacgccaccgccucguucaucuacaacggccggcucguggacuccaucgggucgugguccaagaagauccugcgcacccaggagagcgagugcgucugcaucaacggcacgugcaccguggugaugaccgacggcuccgccucggggaaggcggacaccaagaucaucuucaucgaggagggcaagaucguccacacguccacccugucggggagcgcccagcacguggaggagugcuccugcuacccccgguacccgggcgugcgcugcgucugccgggacaacuggaagggcucgaaccgccccaucguggacaucaacgugaaggacuacuccaucgucucguccuacgugugcagcgggcucgugggcgacacgccccggaagaacgacuccuucucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacucgaagcuccagaccaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcacgagcgggaccuacggcaccggguccuggcccgacggcgccgacaucaaccugaugcccaucuga

SEQ ID NO: 17854 - RNA, 1410 nt, Artificial Sequence; identical to SEQ ID NO: 16547
  derived and/or modified CDS sequence (AUadapt) from InfluenzaA__ABI92646__NA

SEQ ID NO: 17855 - RNA, 1410 nt, Artificial Sequence; identical to SEQ ID NO: 16547
  derived and/or modified CDS sequence (AUadapt) from InfluenzaA__ABI92657__NA

SEQ ID NO: 17856 - RNA, 1410 nt, Artificial Sequence
  derived and/or modified CDS sequence (AUadapt) from InfluenzaA__ABI92668__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcggccccgacaagugcuaccaguucgcccuggggcagggcaccacgcugaacaacggccacagcaacgacaccguccacgaccgcaccccguaccggacccuccugaugaacgagcugggggugcccuuccaccucggcacgcgccaggugugcaucgccugguccucguccucgugccacgacgggaaggcguggcugcacgucugcgugaccggcgacgacaagaacgccaccgccuccuucaucuacaacgggcggcugguggacagcaucggcuccuggucgaagaagauccuccgcacccaggaguccgagugcgucugcaucaacggcacgugcaccguggugaugaccgacgggagcgccuccggcaaggcggacaccaagauccuguucaucgaggaggggaagaucguccacaucucgacgcugagcggcuccgcccagcacguggaggagugcucgugcuacccccgguaccccggcgugcgcugcgucugccgggacaacuggaagggguccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaagggcugggccuucgacgacgggaacgacguguggaugggccgcaccaucucggagaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggaccagcaacucgaucgucguguucugcgggaccuccggcaccuacgggacgggcagcuggccggacggcgccgacaucaaccugaugcccaucuga

SEQ ID NO: 17857 - RNA, 1410 nt, Artificial Sequence; identical to SEQ ID NO: 16993
  derived and/or modified CDS sequence (AUadapt) from InfluenzaA__ABI92679__NA

SEQ ID NO: 17858 - RNA, 1410 nt, Artificial Sequence; identical to SEQ ID NO: 16547
  derived and/or modified CDS sequence (AUadapt) from InfluenzaA__ABI92701__NA

SEQ ID NO: 17859 - RNA, 1410 nt, Artificial Sequence
  derived and/or modified CDS sequence (AUadapt) from InfluenzaA__ABI92712__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggcgaugcucugcgagcccacgaccaccgagcgcaacaccacggagaucguguaccugaccaacaccaccaucgagaaggagaucugccccaagcuggucgaguaccggaacugguccaagccgcagugcaacaucacgggguucgcccccuucucgaaggacaacuccauccgccucagcgccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgccugguccucguccagcugccacgacggcaaggcguggcugcacgucugcgugacgggggacgacaagaacgccaccgccuccuucaucuacaacggccggcugguggacucgaucggguccuggucgaagaagauccuccgcacccaggaguccgagugcgucugcaucaacgggaccugcacgguggugaugaccgacggcucggccuccgggaaggcggacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacucguucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcucgggguacuccggcaucuucagcgucgagggcaaguccugcaucaaccggugcuucuacguggagcugauccgcgggcggaaggaggagaccgaggugugguggacgucgaacucgaucgucguguucugcggcaccuccgggaccuacggcaccgggagcuggccggacggcgccgacaucaaccugaugcccaucuga

SEQ ID NO: 17860 - RNA, 1410 nt, Artificial Sequence
  derived and/or modified CDS sequence (AUadapt) from InfluenzaA__ABI92723__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccagcugccacgacggcaaggccuggcugcacgugugcgugaccggggacgacaagaacgcgaccgccuccuucaucuacaacggccgccuggucgacucgaucggguccuggagcaagaagauccuccggacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgcuaccccggcguccggugcgugugccgcgacaacuggaagggcuccaaccggccgaucguggacaucaacgucaaggacuacagcaucguguccucguacgugugcuccgggcucgucggcgacacgccccgcaagaacgacagcuucuccucgucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcuccagaucaaccgccaggugaucgucgagcggggcaaccggagcggguacuccggcaucuucucgguggagggcaaguccugcaucaaccgcugcuucuacguggagcugauccgggggcgcaaggaggagaccgaggucugguggaccagcaacucgaucgugguguucugcggcaccuccgggaccuacggcacggggagcuggccggacggcgccgacaucaaccugaugcccaucuga

SEQ ID NO: 17861 - RNA, 1410 nt, Artificial Sequence; identical to SEQ ID NO: 16547
  derived and/or modified CDS sequence (AUadapt) from InfluenzaA__ABI92734__NA

SEQ ID NO: 17862 - RNA, 1410 nt, Artificial Sequence; identical to SEQ ID NO: 16993
  derived and/or modified CDS sequence (AUadapt) from InfluenzaA__ABI92745__NA

SEQ ID NO: 17863 - RNA, 1410 nt, Artificial Sequence
  derived and/or modified CDS sequence (AUadapt) from InfluenzaA__ABI92756__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugauccucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 17864 - RNA, 1410 nt, Artificial Sequence
  derived and/or modified CDS sequence (AUadapt) from InfluenzaA__ABI92767__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggagaagaccgaggugugguggaccagcaacucgaucgucguguucugcggcaccuccgggaccuacggcacggggagcuggccggacggcgccgacaucaaccugaugcccaucuga

SEQ ID NO: 17865 - RNA, 1410 nt, Artificial Sequence; identical to SEQ ID NO: 16547
  derived and/or modified CDS sequence (AUadapt) from InfluenzaA__ABI92778__NA

SEQ ID NO: 17866 - RNA, 1410 nt, Artificial Sequence; identical to SEQ ID NO: 16729
  derived and/or modified CDS sequence (AUadapt) from InfluenzaA__ABI92789__NA

SEQ ID NO: 17867 - RNA, 1410 nt, Artificial Sequence; identical to SEQ ID NO: 16729
  derived and/or modified CDS sequence (AUadapt) from InfluenzaA__ABI92800__NA

SEQ ID NO: 17868 - RNA, 1410 nt, Artificial Sequence; identical to SEQ ID NO: 16729
  derived and/or modified CDS sequence (AUadapt) from InfluenzaA__ABI92811__NA

SEQ ID NO: 17869 - RNA, 1410 nt, Artificial Sequence; identical to SEQ ID NO: 16729
  derived and/or modified CDS sequence (AUadapt) from InfluenzaA__ABI92822__NA

SEQ ID NO: 17870 - RNA, 1410 nt, Artificial Sequence; identical to SEQ ID NO: 16729
  derived and/or modified CDS sequence (AUadapt) from InfluenzaA__ABI92844__NA

SEQ ID NO: 17871 - RNA, 1410 nt, Artificial Sequence; identical to SEQ ID NO: 16729
  derived and/or modified CDS sequence (AUadapt) from InfluenzaA__ABI92855__NA

SEQ ID NO: 17872 - RNA, 1410 nt, Artificial Sequence
  derived and/or modified CDS sequence (AUadapt) from InfluenzaA__ABI92866__NA
augaaccccaaccagaagaucaucaccaucggcucggccucccugaccaucgccacgaucugcuuccucauccagaucgcgauccuggugaccaccgucacccugcacuucaagcagcacgagugcaacucgcucccgaacaaccaggugaugcugugcgagcccacgaucaucgagcgcaacaucaccgagaucguguaccugaccaacaccacgaucgagaaggagaucugccccaagcucgccgaguaccggaacugguccaagccccagugcaacaucaccggguucgccccguucagcaaggacaacuccauccgccugucggccggcggggacaucugggucacccgggagcccuacguguccugcgaccccgacaagugcuaccaguucgcccugggccaggggaccacgcucaacaacggccacagcaacgacaccgugcacgaccgcacccccuaccggacccugcugaugaacgagcucggcgucccguuccaccuggggacgcgccaggugugcaucgcgugguccucguccagcugccacgacggcaaggccuggcugcacgugugcgucaccggggacgacaagaacgccaccgccuccuucaucuacaacggccggcucguggacucgaucuccagcugguccaagaagauccugcgcacccaggagucggagugcgugugcaucaacgggacgugcaccgucgugaugaccgacggcuccgcgagcggcaaggccgacaccaagauccuguucaucgaggaggggaagaucauccacaucucgacgcucuccggcucggcccagcacguggaggagugcuccugcuacccccgguaccccgggguccgcugcgugugccgggacaacuggaagggcagcaaccgccccaucguggacaucaacgucaaggacuacuccaucgugucguccuacgugugcagcggccuggucggggacaccccgcggaagaacgacuccuucucguccagccacugccuggaccccaacaacgaggagggcgggcacggcgugaaggggugggccuucgacgacggcaacgacguguggaugggccgcaccaucuccgagaagcuccggucgggguacgagaccuucaaggucaucgagggcugguccaaccccaacagcaagcugcagaucaaccgccaggugaucgucgagcgggggaaccgcuccggcuacucggggaucuucuccguggagggcaagagcugcaucaaccggugcuucuacguggagcugauccgcggccggaaggaggagacggaggucugguggaccucgaacuccaucgugguguucugcgggaccagcggcaccuacgggacgggcuccuggcccgacggggccgacaucaaccucaugccgaucuga

SEQ ID NO: 17873 - RNA, 1410 nt, Artificial Sequence; identical to SEQ ID NO: 16729
  derived and/or modified CDS sequence (AUadapt) from InfluenzaA__ABI92877__NA

SEQ ID NO: 17874 - RNA, 1410 nt, Artificial Sequence; identical to SEQ ID NO: 16729
  derived and/or modified CDS sequence (AUadapt) from InfluenzaA__ABI92888__NA

SEQ ID NO: 17875 - RNA, 1410 nt, Artificial Sequence; identical to SEQ ID NO: 16729
  derived and/or modified CDS sequence (AUadapt) from InfluenzaA__ABI92899__NA

SEQ ID NO: 17876 - RNA, 1410 nt, Artificial Sequence; identical to SEQ ID NO: 16729
  derived and/or modified CDS sequence (AUadapt) from InfluenzaA__ABI92910__NA

SEQ ID NO: 17877 - RNA, 1410 nt, Artificial Sequence; identical to SEQ ID NO: 16729
  derived and/or modified CDS sequence (AUadapt) from InfluenzaA__ABI92921__NA

SEQ ID NO: 17878 - RNA, 1410 nt, Artificial Sequence; identical to SEQ ID NO: 16729
  derived and/or modified CDS sequence (AUadapt) from InfluenzaA__ABI92932__NA

SEQ ID NO: 17879 - RNA, 1410 nt, Artificial Sequence; identical to SEQ ID NO: 17116
  derived and/or modified CDS sequence (AUadapt) from InfluenzaA__ABI92943__NA

SEQ ID NO: 17880 - RNA, 1410 nt, Artificial Sequence; identical to SEQ ID NO: 17116
  derived and/or modified CDS sequence (AUadapt) from InfluenzaA__ABI92954__NA

SEQ ID NO: 17881 - RNA, 1410 nt, Artificial Sequence
  derived and/or modified CDS sequence (AUadapt) from InfluenzaA__ABI92965__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgaccgguccagcuccucgcacugccucgaccccaacaacgaggagggcgggcacggggucaagggcugggccuucgacgacgggaacgacguguggaugggccgcaccaucuccgagaagcugcggagcggcuacgagaccuucaaggucaucgaggggugguccaaccccaacucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 17882 - RNA, 1410 nt, Artificial Sequence; identical to SEQ ID NO: 17116
  derived and/or modified CDS sequence (AUadapt) from InfluenzaA__ABI92976__NA

SEQ ID NO: 17883 - RNA, 1410 nt, Artificial Sequence; identical to SEQ ID NO: 17116
  derived and/or modified CDS sequence (AUadapt) from InfluenzaA__ABI92987__NA

SEQ ID NO: 17884 - RNA, 1410 nt, Artificial Sequence; identical to SEQ ID NO: 17116
  derived and/or modified CDS sequence (AUadapt) from InfluenzaA__ABI92998__NA

SEQ ID NO: 17885 - RNA, 1410 nt, Artificial Sequence; identical to SEQ ID NO: 17320
  derived and/or modified CDS sequence (AUadapt) from InfluenzaA__ABI93009__NA

SEQ ID NO: 17886 - RNA, 1410 nt, Artificial Sequence; identical to SEQ ID NO: 17116
  derived and/or modified CDS sequence (AUadapt) from InfluenzaA__ABI93020__NA

SEQ ID NO: 17887 - RNA, 1413 nt, Artificial Sequence; identical to SEQ ID NO: 17758
  derived and/or modified CDS sequence (AUadapt) from InfluenzaA__ABI93031__NA

SEQ ID NO: 17888 - RNA, 1410 nt, Artificial Sequence; identical to SEQ ID NO: 17513
  derived and/or modified CDS sequence (AUadapt) from InfluenzaA__ABI93042__NA

SEQ ID NO: 17889 - RNA, 1410 nt, Artificial Sequence; identical to SEQ ID NO: 16686
  derived and/or modified CDS sequence (AUadapt) from InfluenzaA__ABI93053__NA

SEQ ID NO: 17890 - RNA, 1410 nt, Artificial Sequence
  derived and/or modified CDS sequence (AUadapt) from InfluenzaA__ABI93064__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacucgaacgacaccguccacgaccggaccccguaccgcacccuccugaugaacgagcugggcgugcccuuccaccucggcacgaagcaggucugcaucgccugguccagcuccucgugccacgacgggaaggcguggcugcacgugugcgugaccggccacgacgagaacgccaccgccuccuucaucuacgacgggcggcugguggacucgaucggcuccuggagcaagaagauccuccgcacccaggaguccgagugcgucugcaucaacgggacgugcaccguggugaugaccgacggcucggccuccggccgggcggacaccaagauccuguucaucgaggaggggaagaucguccacacgucgaagcugagcggcuccgcccagcacguggaggagugcucgugcuacccccgcuaccccggggugcggugcgucugccgcgacaacuggaagggcuccaaccggccgaucguggacaucaacgugaaggacuacagcaucgucuccucguacgugugcuccggccucgugggggacacgccccgcaagaacgacucguccagcuccucgcacugccuggaccccaacaacgaggagggcgggcacggcgucaaggggugggccuucgacgacggcaacgacguguggaugggccggaccaucuccgagaagucccgcucgggguacgagaccuucaaggucaucgagggcuggagcaagcccaacuccaagcugcagaucaaccgccaggugaucguggagcgggggaaccggucgggcuacuccgggaucuucucggucgagggcaagagcugcaucaaccgcugcuucuacguggagcucauccggggccgcaagcaggagaccgaggugugguggaccuccaacucgaucgucguguucugcgggaccuccggcaccuacgggacgggcagcuggccggacggggccgacaucaaccugaugcccaucuga

SEQ ID NO: 17891 - RNA, 1410 nt, Artificial Sequence; identical to SEQ ID NO: 17132
  derived and/or modified CDS sequence (AUadapt) from InfluenzaA__ABI93075__NA

SEQ ID NO: 17892 - RNA, 1410 nt, Artificial Sequence; identical to SEQ ID NO: 17132
  derived and/or modified CDS sequence (AUadapt) from InfluenzaA__ABI93086__NA

SEQ ID NO: 17893 - RNA, 1410 nt, Artificial Sequence; identical to SEQ ID NO: 17132
  derived and/or modified CDS sequence (AUadapt) from InfluenzaA__ABI93097__NA

SEQ ID NO: 17894 - RNA, 1410 nt, Artificial Sequence
  derived and/or modified CDS sequence (AUadapt) from InfluenzaA__ABI93108__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaacgacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaccgaggugcuguggaccucgaacuccaucgucguguucugcgggaccagcggcaccuacgggacgggcuccuggccggacggggccgacaucaaccucaugcccaucuga

SEQ ID NO: 17895 - RNA, 1410 nt, Artificial Sequence
  derived and/or modified CDS sequence (AUadapt) from InfluenzaA__ABI93119__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacaacuccucguccucgcacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagcccaacucgaagcuccagaucaaccgccaggugaucguggaccgguccaaccggagcggcuacuccgggaucuucucggucgagagcaaguccugcaucaaccgcugcuucuacguggagcugauccggggccgcaagcaggagaccgaggugcuguggaccucgaacuccaucgucguguucugcggcaccagcgggaccuacggcacgggguccuggccggacggcgccgacaucaaccucaugcccaucuga

SEQ ID NO: 17896 - RNA, 1416 nt, Artificial Sequence
  derived and/or modified CDS sequence (AUadapt) from InfluenzaA__ABI94584__NA
augaaucccaaccagaagcuguucgcccucucgggcguggccaucgcgcuguccguccugaaccuccugaucgggaucucgaacgugggccugaacgugucccuccaccugaaggagaaggggccgaagcaggaggagaaccugaccugcaccacgaucaaccagaacaacaccaccgucguggagaacaccuacgugaacaacacgaccaucaucaccaagggcaccgaccucaagacgcccucguaccugcugcucaacaagucccugugcaacgucgagggguggguggugaucgccaaggacaacgccguccgcuucggcgagagugagcagaucaucgugacccgggagcccuacguguccugcgaccccaccggcugcaagauguacgcccugcaccaggggaccacgauccgcaacaagcacucgaacggcaccauccacgaccggaccgccuuccgcgggcucaucuccaccccgcugggcacgccgcccaccgucucgaacuccgacuucaugugcgugggguggucguccacgaccugccacgacggcaucgcgcggaugaccaucugcauccagggcaacaacgacaaugccaccgccaccguguacuacaaccgccggcugaccacgaccaucaagaccugggcccgcaacauccuccggacccaggagucggagugcgucugccacaacgggacgugcgcgguggugaugaccgacggcuccgccucgucccaggccuacaccaaggucauguacuuccacaaggggcugguggugaaggaggaggagcugcgcggcucggcccggcacaucgaggagugcuccugcuacggccacaaccagaaggugaccugcgucugccgcgacaacuggcagggggccaaucggcccaucaucgagaucgacaugucgacgcucgagcacaccucgcgcuacgugugcaccggcauccugaccgacacgucccggcccggggacaagucguccggcgacugcucgaaccccaucaccgggucccccggcguccccggcgugaagggguucggcuuccugaacggggacaacaccuggcucggccgcaccaucucgccgcggucccgcucgggguucgagaugcugaagauccccaacgcgggcaccgaccccaacucccggaucgccgagcgccaggagaucgucgacaacaauaacuggucgggcuacuccgggucguucaucgacuacuggaacgacaacuccgagugcuacaaccccugcuucuacguggagcugauccggggccgcccggaggaggccaaguacguguggugggccucgaacucccucaucgcccugugcgggucgcccuuccccgucggcuccgggucguuccccgacggcgcgcagauccaguacuucuccuga

SEQ ID NO: 17897 - RNA, 1413 nt, Artificial Sequence; identical to SEQ ID NO: 17230
  derived and/or modified CDS sequence (AUadapt) from InfluenzaA__ABI95220__NA

SEQ ID NO: 17898 - RNA, 1410 nt, Artificial Sequence
  derived and/or modified CDS sequence (AUadapt) from InfluenzaA__ABI95242__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacggccgcaccccguaccggacccugcucaugaacgagcugggcgugcccuuccaccuggggacgaagcaggucugcaucgccuggagcuccucguccugccacgacggcaaggccuggcuccacgugugcgugaccggggacgacaagaacgcgaccgccagcuucaucuacaacggccgccugguggacuccaucgucagcugguccaaggagauccugcggacccaggagucggagugcgugugcaucaacgggacgugcaccguggucaugaccgacggcuccgccagcggcgaggccgacaccaagauccucuucaucgaggaggggaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucgggccuggugggggacacgccccgcaagaacgacuccagcuccagcucccacugccucgaccccaacaacgaggagggcgggcacggcgucaaggggugggccuucgacgacggcaacgacguguggaugggccggaccaucucggagaagcugcgcuccggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 17899 - RNA, 1413 nt, Artificial Sequence
  derived and/or modified CDS sequence (AUadapt) from InfluenzaA__ABI95253__NA
augaaccccaaccagaagaucaucaccaucggcucgaucuccaucgccaucgggaucaucucgaucaugcugcagaucggcaacaucaucuccaucugggccagccacuccauccagaccgggucgcagaaccacacgggcaucugcaaccagcgcaucaucaccuacgagaacuccaccugggugaaccacaccuacgucaacaucaacaacacgaacgugguggcggggaaggacaagaccagcgucacccucgccggcaacuccucgcugugcuccaucagcggcugggccaucuacaccaaggacaacuccauccggaucgggucgaagggcgacguguucgugauccgcgagccguucaucuccugcagccaccuggagugccggacguucuuccucacccagggggcccugcugaacgacaagcacuccaacggcaccgucaaggaccgcucgcccuaccgggcccucauguccugcccccugggggaggcgcccagcccguacaacucgaaguucgaguccguggccuggagcgccuccgccugccacgacggcaugggcuggcugaccaucgggaucucgggccccgacaacggggcgguggccguccucaaguacaacggcaucaucacggagaccaucaaguccuggaagaagcgcauccugcggacccaggagagcgagugcgugugcgugaacggcuccugcuucaccaucaugacggacgggcccucggacggcgccgccuccuacaagaucuucaagaucgagaaggggaaggucaccaagagcaucgagcugaacgcccccaacucccacuacgaggagugcucgugcuacccggacaccggcaccgugaugugcgugugccgcgacaacuggcacggguccaaccggcccugggucagcuucaaccagaaccucgacuaccagaucggcuacaucugcuccggcguguucggggacaacccccgccccaaggacggcgaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucucggucaagcaggacgugguggccaucacggacuggagcggguacuccggcucguucguccagcaccccgagcugaccggccucgacugcauccgccccugcuucuggguggagcugguccgggggcgcccgcgggagaacaccaccaucuggacguccggcagcuccaucucguucugcggggugaacuccgacaccgccaacuggagcuggcccgacggcgccgagcugcccuucaccaucgacaaguga

SEQ ID NO: 17900 - RNA, 1413 nt, Artificial Sequence; identical to SEQ ID NO: 17758
  derived and/or modified CDS sequence (AUadapt) from InfluenzaA__ABI95264__NA

SEQ ID NO: 17901 - RNA, 1413 nt, Artificial Sequence; identical to SEQ ID NO: 17758
  derived and/or modified CDS sequence (AUadapt) from InfluenzaA__ABI95275__NA

SEQ ID NO: 17902 - RNA, 1413 nt, Artificial Sequence; identical to SEQ ID NO: 17758
  derived and/or modified CDS sequence (AUadapt) from InfluenzaA__ABI95286__NA

SEQ ID NO: 17903 - RNA, 1413 nt, Artificial Sequence
  derived and/or modified CDS sequence (AUadapt) from InfluenzaA__ABI95297__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaagaaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 17904 - RNA, 1410 nt, Artificial Sequence; identical to SEQ ID NO: 17132
  derived and/or modified CDS sequence (AUadapt) from InfluenzaA__ABI95308__NA

SEQ ID NO: 17905 - RNA, 1413 nt, Artificial Sequence; identical to SEQ ID NO: 16788
  derived and/or modified CDS sequence (AUadapt) from InfluenzaA__ABI96131__NA

SEQ ID NO: 17906 - RNA, 1413 nt, Artificial Sequence; identical to SEQ ID NO: 16788
  derived and/or modified CDS sequence (AUadapt) from InfluenzaA__ABI96133__NA

SEQ ID NO: 17907 - RNA, 1413 nt, Artificial Sequence; identical to SEQ ID NO: 16788
  derived and/or modified CDS sequence (AUadapt) from InfluenzaA__ABI96136__NA

SEQ ID NO: 17908 - RNA, 1410 nt, Artificial Sequence
  derived and/or modified CDS sequence (AUadapt) from InfluenzaA__ABJ09110__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucauccacacgucgagccuguccgggucggcccagcacgucgaggagugcuccugcuacccccgcuaccccggcgugcggugcgugugccgcgacaacuggaagggcagcaaccggccgaucgucgacaucaacgugaaggacuacuccaucgugucguccuacgucugcagcgggcucgugggcgacacgccccgcaagaacgacuccucguccucgucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcuccagaucaaccggcaggucaucguggaccgcggcaaccggagcggguacuccggcaucuucucgguggagagcaaguccugcaucaaccgcugcuucuacgucgagcugauccggggccgcaagcaggagaccgaggugcuguggaccucgaacuccaucguggucuucugcgggaccagcggcaccuacgggacgggcuccuggccggacggggccgacaucaaccucaugcccaucuga

SEQ ID NO: 17909 - RNA, 1410 nt, Artificial Sequence; identical to SEQ ID NO: 17503
  derived and/or modified CDS sequence (AUadapt) from InfluenzaA__ABJ09143__NA

SEQ ID NO: 17910 - RNA, 1413 nt, Artificial Sequence; identical to SEQ ID NO: 17327
  derived and/or modified CDS sequence (AUadapt) from InfluenzaA__ABJ09154__NA

SEQ ID NO: 17911 - RNA, 1410 nt, Artificial Sequence; identical to SEQ ID NO: 16729
  derived and/or modified CDS sequence (AUadapt) from InfluenzaA__ABJ09165__NA

SEQ ID NO: 17912 - RNA, 1410 nt, Artificial Sequence; identical to SEQ ID NO: 16729
  derived and/or modified CDS sequence (AUadapt) from InfluenzaA__ABJ09176__NA

SEQ ID NO: 17913 - RNA, 1410 nt, Artificial Sequence; identical to SEQ ID NO: 17116
  derived and/or modified CDS sequence (AUadapt) from InfluenzaA__ABJ09198__NA

SEQ ID NO: 17914 - RNA, 1410 nt, Artificial Sequence; identical to SEQ ID NO: 17116
  derived and/or modified CDS sequence (AUadapt) from InfluenzaA__ABJ09209__NA

SEQ ID NO: 17915 - RNA, 1410 nt, Artificial Sequence
  derived and/or modified CDS sequence (AUadapt) from InfluenzaA__ABJ09220__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcgaaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcgcggcaccacgcugaacaaccggcacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccgggcacgacgagaacgccaccgccuccuucaucuacgacggccgccugguggacucgaucggguccuggucgaagaacauccuccggacccaggaguccgagugcgucugcaucaacggcacgugcaccguggugaugaccgacggcagcgccuccgagcgcgcggacaccaagauccuguucaucgaggaggggaagaucguccacaucucgccccugagcggcuccgcccagcacguggaggagugcucgugcuacccccgguacccgggggugcgcugcgucugccgggacaacuggaagggcuccaaccgccccaucguggacaucaacgugaaggacuacagcaucgucuccucguacgugugcuccggccucgugggggacacgccccggaagaacgacagcuccucguccucguacugccgcaaccccaacaacgagaagggcucccacggggucaagggcugggccuucgacgacgggaacgacguguggaugggccggaccaucagcgaggagcugcgcuccggcuacgagaccuucaaggucaucgggggcuggucgaagccgaacuccaagcugcagaucaaccgccaggugaucguggaccgggggaaccggagcggcuacuccgggaucuucucggucgagggcaagagcugcaucaaccgcugcuucuacguggagcucauccgcggccggaagcaggagaccgaggugugguggacguccaacucgaucgucguguucugcgggaccuccggcaccuacgggaccggcagcuggcccgacggggccgacaucaaccugaugcccaucuga

SEQ ID NO: 17916 - RNA, 1410 nt, Artificial Sequence; identical to SEQ ID NO: 17132
  derived and/or modified CDS sequence (AUadapt) from InfluenzaA__ABJ09231__NA

SEQ ID NO: 17917 - RNA, 1410 nt, Artificial Sequence; identical to SEQ ID NO: 17132
  derived and/or modified CDS sequence (AUadapt) from InfluenzaA__ABJ09242__NA

SEQ ID NO: 17918 - RNA, 1410 nt, Artificial Sequence; identical to SEQ ID NO: 16686
  derived and/or modified CDS sequence (AUadapt) from InfluenzaA__ABJ09253__NA

SEQ ID NO: 17919 - RNA, 1410 nt, Artificial Sequence
  derived and/or modified CDS sequence (AUadapt) from InfluenzaA__ABJ09264__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuacaugaccaacaccacgaucgagaaggagaucugccccaagcuggcggaguaccggaacugguccaagccgcagugcaacaucaccggguucgcccccuucagcaaggacaacuccauccgccugucggccggcggggacaucugggugacccgggagcccuacguguccugcgaccccgacaagugcuaccaguucgcccucggccaggggaccacgcugaacaaccgccacagcaacgacaccguccacgaccggaccccguaccgcacccugcucaugaacgagcugggcgugcccuuccaccugggcacgaagcaggucugcaucgccugguccucguccucgugccacgacgggaaggcguggcuccacgugugcgugaccggccacgacgagaacgccaccgccuccuucaucuacaacgggcggcugguggacagcaucggcuccuggucgaagaagauccugcgcacccaggaguccgagugcgucugcaucaacgggacgugcaccguggugaugaccgacggcagcgccuccggcaaggcggacaccaagauccucuucaucgaggaggggaagaucguccacaucucgccccugucgggcuccgcccagcacguggaggagugcagcugcuacccccgguacccgggggugcgcugcgucugccgggacaacuggaagggcuccaaccgccccaucguggacaucaacgugaaggacuacucgaucgucuccagcuacgugugcuccggccuggugggggacacgccccggaagaacgacucguccucguccagccacugccucaaccccaacaacgaggagggcgggcacggcgucaaggggugggccuucgacgacggcaacgacguguggaugggccgcaccaucuccgagaagcugcggucgggguacgagaccuucaaggucaucgagggcugguccaagccgaacagcaagcugcagaucaaccgccaggugaucguggaccgggggaacuccucgggcuacuccgggaucuucucggucgagggcaagagcugcaucaaccgcugcuucuacguggagcucauccggggccgcaagcaggagaccgaggugugguggacguccaacucgaucgucgugcugugcgggaccuccggcaccuacgggaccggcagcuggcccgacggggccgacaucaaccugaugcccaucuga

SEQ ID NO: 17920 - RNA, 1410 nt, Artificial Sequence
  derived and/or modified CDS sequence (AUadapt) from InfluenzaA__ABJ09286__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacacgagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacucgaagcuccagaucaacaagcaggucaucguggaccggggcaaccgcuccggguacucgggcaucuucuccguggagggcaagagcugcaucaaccggugcuucuacguggagcugauccgcgggcggaagcaggagaccgaggugcuguggaccucgaacuccaucgucguguucugcggcaccagcgggaccuacggcacgggguccuggcccgacggcgccgacaucaaccucaugcccaucuga

SEQ ID NO: 17921 - RNA, 1410 nt, Artificial Sequence; identical to SEQ ID NO: 16686
  derived and/or modified CDS sequence (AUadapt) from InfluenzaA__ABJ09308__NA

SEQ ID NO: 17922 - RNA, 1410 nt, Artificial Sequence; identical to SEQ ID NO: 17890
  derived and/or modified CDS sequence (AUadapt) from InfluenzaA__ABJ09319__NA

SEQ ID NO: 17923 - RNA, 1413 nt, Artificial Sequence; identical to SEQ ID NO: 17355
  derived and/or modified CDS sequence (AUadapt) from InfluenzaA__ABJ09330__NA

SEQ ID NO: 17924 - RNA, 1410 nt, Artificial Sequence
  derived and/or modified CDS sequence (AUadapt) from InfluenzaA__ABJ09341__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccugcucggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccggggcaaccgguccggguacagcggcaucuucuccgucgagucgaagagcugcaucaaccgcugcuucuacguggagcugauccggggccgcaagcaggagaccgaggugcucuggaccuccaacucgaucgucguguucugcgggaccuccggcaccuacgggacgggcagcuggccggacggggccgacaucaaccugaugcccaucuga

SEQ ID NO: 17925 - RNA, 1410 nt, Artificial Sequence
  derived and/or modified CDS sequence (AUadapt) from InfluenzaA__ABJ09352__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgaagcaggucugcaucgccugguccucguccagcugccacgacgggaaggcguggcugcacgugugcgugaccggcgacgacgagaacgccaccgccuccuucaucuacaacgggcgccugguggacucgaucggcuccuggucgaagaagauccuccggacccaggaguccgagugcgucugcaucaacggcacgugcaccguggugaugaccgacgggagcgccuccggcaaggcggacaccaagauccuguucaucgaggaggggaagaucguccacacgucgagccuguccggcucggcccagcacguggaggagugcuccugcuacccccgcuaccccggcgugcggugcgucugccgcgacaacuggaaggggagcaaccggccgaucguggacaucaacgugaaggacuacuccaucgucucguccuacgugugcagcggccucgugggggacacgccccgcaagaacgacuccucguccucgucccacugccuggaccccaacaacgaggagggcgggcacggcgucaagggcugggccuucgacgacgggaacgacguguggaugggccggaccaucagcgagaagcugcgcuccggguacgagaccuucaaggucaucgagggcuggucgaagcccaacuccaagcuccagaucaaccgccaggugaucguggaccgggggaaccggagcggcuacuccggcaucuucucggucgagagcaaguccugcaucaaccgcugcuucuacguggagcugauccgggggcgcaagcaggagaccgaggugcuguggaccucgaacuccaucgucguguucugcggcaccagcgggaccuacggcacgggguccuggccggacggcgccgacaucaaccucaugcccaucuga

SEQ ID NO: 17926 - RNA, 1407 nt, Artificial Sequence
  derived and/or modified CDS sequence (AUadapt) from InfluenzaA__ABJ09374__NA
augauccagucgaagaucaucaccaucggcuccgugagccugaccaucuccacgaucugcuucuucaugcagaucgccauccucaucaccaccgucacccugcacuucaagcaguacgaguucaacucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccacgaccgcacccccuaccggacccugcucaugaacgagcugggcgugccguuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacucgaucgucuccuggagcaagaagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggcccaucguggacaucaacaucaaggacuacagcaucgucuccagcuacgugugcuccggccuggugggcgacaccccgcgcaagaacgacucguccagcuccagccacugccucgaccccaacaacgaggagggcgggcacggggucaagggcugggccuucgacgacgggaacgacguguggaugggccggaccaucuccgagaagcugcgcucgggcuacgagacguucaaggucaucgaggggugguccaaccccaacagcaagcugcagaucaaccgccaggugaucguggaccggggcaaccgguccggguacagcggcaucuucucggucgaggggaaguccugcaucaaccgcugcuucuacguggagcucauccggggcaagaaggaggagaccgaggugcuguggaccagcaacuccaucgucguguucugcggcaccagcgggacguacggcaccggguccuggcccgacggcgccgacaucaaccugaugccgaucuga

SEQ ID NO: 17927 - RNA, 1410 nt, Artificial Sequence; identical to SEQ ID NO: 17116
  derived and/or modified CDS sequence (AUadapt) from InfluenzaA__ABJ09385__NA

SEQ ID NO: 17928 - RNA, 1410 nt, Artificial Sequence; identical to SEQ ID NO: 16655
  derived and/or modified CDS sequence (AUadapt) from InfluenzaA__ABJ16590__NA

SEQ ID NO: 17929 - RNA, 1410 nt, Artificial Sequence; identical to SEQ ID NO: 17920
  derived and/or modified CDS sequence (AUadapt) from InfluenzaA__ABJ16601__NA

SEQ ID NO: 17930 - RNA, 1413 nt, Artificial Sequence
  derived and/or modified CDS sequence (AUadapt) from InfluenzaA__ABJ16612__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccgucgggaucagcggccccgacaacggggcgguggccgugcugaaguacaacggcaucaucacggagaccaucaaguccuggaagaagcgcauccugcggacccaggagucggagugcgucugcgugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucguccagcaccccgagcucaccggccuggacugcauccgccccugcuucuggguggagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 17931 - RNA, 1410 nt, Artificial Sequence; identical to SEQ ID NO: 17920
  derived and/or modified CDS sequence (AUadapt) from InfluenzaA__ABJ16623__NA

SEQ ID NO: 17932 - RNA, 1410 nt, Artificial Sequence
  derived and/or modified CDS sequence (AUadapt) from InfluenzaA__ABJ16634__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaucaccaucgagaaggagaucugccccaagcuggccgaguaccggaacuggucgaagccgcagugcgacaucacgggguucgcgcccuucuccaaggacaacagcauccgccuguccgccggcggggacaucugggucacccgggagcccuacgugagcugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggucguccagcuccugccacgacgggaaggccuggcuccacgugugcgugacgggcgacgacaagaacgcgaccgccucguucaucuacaacgggcgccugguggacuccaucgucagcugguccaagaagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggaccuacggcacggggagcuggccggacggcgccgacaucaaccugaugcccaucuga

SEQ ID NO: 17933 - RNA, 1413 nt, Artificial Sequence; identical to SEQ ID NO: 16788
  derived and/or modified CDS sequence (AUadapt) from InfluenzaA__ABJ16656__NA

SEQ ID NO: 17934 - RNA, 1413 nt, Artificial Sequence; identical to SEQ ID NO: 16788
  derived and/or modified CDS sequence (AUadapt) from InfluenzaA__ABJ16667__NA

SEQ ID NO: 17935 - RNA, 1413 nt, Artificial Sequence
  derived and/or modified CDS sequence (AUadapt) from InfluenzaA__ABJ16678__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuuccucgucaagcaggacgugguggccaucacggacugguccggguacucgggcagcuucguccagcaccccgagcugaccggccuggacugcauccgccccugcuucuggguggagcucguccgggggcugccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 17936 - RNA, 1413 nt, Artificial Sequence; identical to SEQ ID NO: 16788
  derived and/or modified CDS sequence (AUadapt) from InfluenzaA__ABJ16689__NA

SEQ ID NO: 17937 - RNA, 1410 nt, Artificial Sequence
  derived and/or modified CDS sequence (AUadapt) from InfluenzaA__ABJ16700__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggcaagaagcaggagaccgaggugcuguggaccucgaacuccaucgucguguucugcgggaccagcggcaccuacgggacgggcuccuggccggacggggccgacaucaaccucaugcccaucuga

SEQ ID NO: 17938 - RNA, 1410 nt, Artificial Sequence
  derived and/or modified CDS sequence (AUadapt) from InfluenzaA__ABJ16711__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacaucaaggacuacuccaucgugagcuccuacgucugcucggggcucgugggcgacacgccccgcaagaacgacuccucguccagcucccacugccuggaccccaacaacgaggagggcgggcacggggugaagggcugggccuucgacgacggcaacgacgccuggauggggcggaccaucucggagaagcugcgcuccggcuacgagaccuucaaggucaucgagggguggagcaaguccaacucgaagcuccagaucaaccgccaggugaucgucgaccggggcaaccgguccggguacucgggcaucuucagcguggagggcaaguccugcaucaaccgcugcuucuacguggagcugauccgggggcgcaagcaggagaccgagguccuguggaccucgaacuccaucgugguguucugcggcaccagcgggaccuacggcacgggguccuggcccgacggcgccgacaucaaccucaugccgaucuga

SEQ ID NO: 17939 - RNA, 1413 nt, Artificial Sequence
  derived and/or modified CDS sequence (AUadapt) from InfluenzaA__ABJ16733__NA
augaaccccaaccagaagaucaucaccaucggcucgaucuccguggccaucgggaucaucaaccugauccuccagaucggcaacaucaucagcaucugggccucccacucgauccagaccgggucccagaacuacacgggcaucugcaaccagcgcaucaucaccuacgagaaccggaccugggucaaccagaccuacgugaacaucaacaacacgaacguggucgcggggaaggacaagaccagcaugacccuggccggcaacuccucgcugugcccgauccgcggcugggccaucuacaccaaggacaacuccauccggaucgggagcaagggcgacaucuucgugauccgcgagcccuucaucuccugcucgcaccucgagugccggacguucuuccugacccagggggcccugcucaacgacaagcacuccaacggcaccaucaaggaccgcagccccuuccgggcccugauguccugcccccugggggaggcgccgucgcccuacaacucccgcuucgagagcguggccugguccgccucggccugccacgacggccucggcuggcugaccaucgggaucagcggccccgacaacggggcggucgccgugcugaaguacaacggcaucaucacggagaccaucaaguccuggaagaagcagauccuccggacccaggagucggagugcgugugcgucaacggcuccugcuucaccaucaugacggacgggcccagcaaccgcgccgccuccuaccggaucuucaagaucgagaagggccgcgugaccaagucgaucgagcuggacgccccgaacuaccacuacgaggagugcuccugcuaccccgacaccgggaccgugaugugcgucugccgggacaacuggcacggcagcaaccgccccuggguguccuucaaccagaaccuggacuaccagaucggguacaucugcucgggcguguucggcgacaacccccggccgaaggacggggagggcuccugcaaccccgucacgguggacggggcggacggcgugaagggguucagcuaccgcuacggcaacggcgucuggaucgggcggaccaaguccaaccgccuccggaagggcuucgagaugaucugggaccccaacggguggaccgacaccgacucggacuucuccaugaagcaggacgugguggccaugacggacuggagcggcuacuccgggucguucguccagcaccccgagcugaccggccuggacugcaugcgcccgugcuucuggguggagcucgugcggggccugccccgcgagaacaccaccaucuggacguccgggagcucgaucuccuucugcggcgucaacagcgagaccgccaacugguccuggcccgacggggccgagcugcccuucaccaucgacaaguga

SEQ ID NO: 17940 - RNA, 1410 nt, Artificial Sequence; identical to SEQ ID NO: 17132
  derived and/or modified CDS sequence (AUadapt) from InfluenzaA__ABJ16744__NA

SEQ ID NO: 17941 - RNA, 1410 nt, Artificial Sequence; identical to SEQ ID NO: 17132
  derived and/or modified CDS sequence (AUadapt) from InfluenzaA__ABJ16755__NA

SEQ ID NO: 17942 - RNA, 1410 nt, Artificial Sequence; identical to SEQ ID NO: 17132
  derived and/or modified CDS sequence (AUadapt) from InfluenzaA__ABJ16766__NA

SEQ ID NO: 17943 - RNA, 1410 nt, Artificial Sequence
  derived and/or modified CDS sequence (AUadapt) from InfluenzaA__ABJ16777__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacaucaaggacuacuccaucgugagcuccuacgucugcucggggcucgugggcgacacgccccgcaagaacgacuccucguccagcucccacugccuggaccccaacaacgaggagggcgggcacggggugaagggcugggccuucgacgacggcaacgacgucuggauggggcggaccaucucggagaagcugcgcuccggcuacgagaccuucaaggugaucgagggguggagcaagcccaacuccaagcuccagaucaaccggcaggucaucguggaccgcggcaaccggucgggguacuccggcaucuucucgguggagggcaagagcugcaucaaccgcugcuucuacgucgagcugauccgggggcgcaagcaggagaccgaggugcuguggaccuccaacucgaucguggucuucugcggcaccuccgggaccuacggcacggggagcuggccggacggcgccgacaucaaccucaugcccaucuga

SEQ ID NO: 17944 - RNA, 1410 nt, Artificial Sequence; identical to SEQ ID NO: 17132
  derived and/or modified CDS sequence (AUadapt) from InfluenzaA__ABJ16788__NA

SEQ ID NO: 17945 - RNA, 1413 nt, Artificial Sequence; identical to SEQ ID NO: 17370
  derived and/or modified CDS sequence (AUadapt) from InfluenzaA__ABJ53441__NA

SEQ ID NO: 17946 - RNA, 1413 nt, Artificial Sequence
  derived and/or modified CDS sequence (AUadapt) from InfluenzaA__ABJ53452__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugaucgcggggaaggacaagaccucggugacccuggccggcaacuccagccugugcuccaucagcggcugggccaucuacaccaaggacaacuccauccggaucgggucgaagggcgacgucuucgugauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacggagaccaucaaguccuggaagaagcgcauccugcggacccaggagucggagugcgucugcgugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccgacaccgacagcaacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 17947 - RNA, 1410 nt, Artificial Sequence; identical to SEQ ID NO: 17114
  derived and/or modified CDS sequence (AUadapt) from InfluenzaA__ABJ53463__NA

SEQ ID NO: 17948 - RNA, 1410 nt, Artificial Sequence; identical to SEQ ID NO: 17114
  derived and/or modified CDS sequence (AUadapt) from InfluenzaA__ABJ53474__NA

SEQ ID NO: 17949 - RNA, 1410 nt, Artificial Sequence
  derived and/or modified CDS sequence (AUadapt) from InfluenzaA__ABJ53485__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgccugggcuacgagaccuucaaggucaucgaggggugguccaacagcaacuccaagcuccagaccaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcacguccgggaccuacggcaccgggagcuggcccgacggcgccgacaucaaccucaugccgaucuga

SEQ ID NO: 17950 - RNA, 1413 nt, Artificial Sequence; identical to SEQ ID NO: 17758
  derived and/or modified CDS sequence (AUadapt) from InfluenzaA__ABJ53496__NA

SEQ ID NO: 17951 - RNA, 1413 nt, Artificial Sequence; identical to SEQ ID NO: 17758
  derived and/or modified CDS sequence (AUadapt) from InfluenzaA__ABJ53507__NA

SEQ ID NO: 17952 - RNA, 1413 nt, Artificial Sequence
  derived and/or modified CDS sequence (AUadapt) from InfluenzaA__ABJ53518__NA
augaaccccaaccagaagaucaucaccaucggcucgaucuccguggccaucgggaucaucaaccugauccuccagaucggcaacaucaucagcaucugggccucccacucgauccagaccgggucccagaacuacacgggcaucugcaaccagcgcaucaucaccuacgagaaccggaccugggucaaccagaccuacgugaacaucaacaacacgaacguggucgcggggaaggacaagaccagcaugacccuggccggcaaccugucccucugcccgauccgcggcugggccaucuacaccaaggacaacucgauccggaucggguccaagggcgacguguucgugauccgcgagcccuucaucagcugcucccaccuggagugccggacguucuuccugacccagggggcccuccugaacgacaagcacucgaacggcaccaucaaggaccgcucccccuuccgggcccugaugagcugcccccucggggaggcgccgucccccuacaacucgcgcuucgaguccgucgccuggagcgccuccgccugccacgacggccugggcuggcugaccaucgggaucucgggccccgacaacggggcgguggccgugcucaaguacaacggcaucaucacggagaccaucaagagcuggaagaagcagauccugcggacccaggaguccgagugcgucugcgugaacggcucgugcuucaccaucaugacggacgggcccuccaaccgcgccgccagcuaccggaucuucaagaucgagaagggccgcgugaccaaguccaucgagcuggacgccccgaacuaccacuacgaggagugcucgugcuaccccgacaccgggaccgucaugugcgugugccgggacaacuggcacggcuccaaccgccccugggugagcuucaaccagaaccucgacuaccagaucggguacaucugcuccggcgucuucggcgacaacccccggccgaaggacggggagggcucgugcaaccccgugacgguggacggggcggacggcgucaagggguucuccuaccgcuacggcaacggcguguggaucgggcggaccaagagcaaccgccugcggaagggcuucgagaugaucugggaccccaacggguggaccgacaccgacuccgacuucucgaugaagcaggacguggucgccaugacggacugguccggcuacagcggguccuucgugcagcaccccgagcugaccggccucgacugcaugcgcccgugcuucuggguggagcugguccggggccugccccgcgagaacaccaccaucuggacgucgggguccagcaucucguucugcggcgugaacuccgagaccgccaacuggagcuggcccgacggggccgagcuccccuucaccaucgacaaguga

SEQ ID NO: 17953 - RNA, 1410 nt, Artificial Sequence; identical to SEQ ID NO: 16556
  derived and/or modified CDS sequence (AUadapt) from InfluenzaA__ABK39965__NA

SEQ ID NO: 17954 - RNA, 1410 nt, Artificial Sequence
  derived and/or modified CDS sequence (AUadapt) from InfluenzaA__ABK39976__NA
augaaccccaaccagaagaucaucaccaucggcucggugucccugaccaucagcacgaccugcuucuucaugcagaucgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacgcaggagagcgagugcgugugcaucaacgggaccugcgccguggucaugaccgacggguccgccucgggcaaggcggacaccaagauccucuucaucgaggagggcaagaucgugcacacgagcacccuguccgggucggcccagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 17955 - RNA, 1410 nt, Artificial Sequence; identical to SEQ ID NO: 17114
  derived and/or modified CDS sequence (AUadapt) from InfluenzaA__ABK39987__NA

SEQ ID NO: 17956 - RNA, 1410 nt, Artificial Sequence; identical to SEQ ID NO: 16784
  derived and/or modified CDS sequence (AUadapt) from InfluenzaA__ABK39998__NA

SEQ ID NO: 17957 - RNA, 1410 nt, Artificial Sequence; identical to SEQ ID NO: 16729
  derived and/or modified CDS sequence (AUadapt) from InfluenzaA__ABK40020__NA

SEQ ID NO: 17958 - RNA, 1413 nt, Artificial Sequence
  derived and/or modified CDS sequence (AUadapt) from InfluenzaA__ABK40031__NA
augaaccccaaccagaagaucaucaccaucggcucgaucuccguggccaucgggaucaucaaccugauccuccagaucggcaacaucaucagcaucugggccucccacucgauccagaccgggucccagaacuacacgggcaucugcaaccagcgcaucaucaccuacgagaaccggaccugggucaaccagaccuacgugaacaucaacaacacgaacguggucgcggggaaggacaagaccagcaugacccuggccggcaacuccucgcugugcccgauccgcggcugggccaucuacaccaaggacaacuccauccggaucgggagcaagggcgacguguucgugauccgcgagcccuucaucuccugcucgcaccucgagugccggacguucuuccugacccagggggcccugcucaacgacaagcacuccaacggcaccaucaaggaccgcagccccuuccgggcccugauguccugcccccugggggaggcgccgucgcccuacaacucccgcuucgagagcgucgccugguccgccucggccugccacgacggccucggcuggcugaccaucgggaucagcggccccgacaacggggcgguggccgugcugaaguacaacggcaucaucacggagaccaucaaguccuggaagaagcagauccuccggacccaggagucggagugcgucugcgugaacggcuccugcuucaccaucaugacggacgggcccagcaaccgcgccgccuccuaccggaucuucaagaucgagaagggccgcgugaccaagucgaucgagcuggacgccccgaacuaccacuacgaggagugcuccugcuaccccgacaccgggaccgucaugugcgugugccgggacaacuggcacggcagcaaccgccccuggguguccuucaaccagaaccuggacuaccagaucggguacaucugcucgggcgucuucggcgacaacccccggccgaaggacggggagggcuccugcaaccccgugacgguggacggggcggacggcgucaagggguucagcuaccgcuacggcaacggcguguggaucgggcggaccaaguccaaccgccuccggaagggcuucgagaugaucugggaccccaacggguggaccgacaccgacucggacuucuccaugaagcaggacguggucgccaugacggacuggagcggcuacuccgggucguucgugcagcaccccgagcugaccggccuggacugcaugcgcccgugcuucuggguggagcucguccggggccugccccgcgagaacaccaccaucuggacguccgggagcucgaucuccuucugcggcgugaacagcgagaccgccaacugguccuggcccgacggggccgagcugcccuucaccaucgacaaguga

SEQ ID NO: 17959 - RNA, 1413 nt, Artificial Sequence; identical to SEQ ID NO: 17958
  derived and/or modified CDS sequence (AUadapt) from InfluenzaA__ABK40042__NA

SEQ ID NO: 17960 - RNA, 1413 nt, Artificial Sequence; identical to SEQ ID NO: 17958
  derived and/or modified CDS sequence (AUadapt) from InfluenzaA__ABK40053__NA

SEQ ID NO: 17961 - RNA, 1410 nt, Artificial Sequence; identical to SEQ ID NO: 17132
  derived and/or modified CDS sequence (AUadapt) from InfluenzaA__ABK40064__NA

SEQ ID NO: 17962 - RNA, 1410 nt, Artificial Sequence; identical to SEQ ID NO: 17132
  derived and/or modified CDS sequence (AUadapt) from InfluenzaA__ABK40078__NA

SEQ ID NO: 17963 - RNA, 1413 nt, Artificial Sequence; identical to SEQ ID NO: 17461
  derived and/or modified CDS sequence (AUadapt) from InfluenzaA__ABK40513__NA

SEQ ID NO: 17964 - RNA, 1413 nt, Artificial Sequence; identical to SEQ ID NO: 17461
  derived and/or modified CDS sequence (AUadapt) from InfluenzaA__ABK40538__NA

SEQ ID NO: 17965 - RNA, 1413 nt, Artificial Sequence
  derived and/or modified CDS sequence (AUadapt) from InfluenzaA__ABK40549__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgcccuaccgcgcccugauguccugccccaucggggaggccccgagccccuacaacucccgguucgagucgguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagucggagugcgugugcgucaacggcuccugcuucacgaucaugaccgacgggcccagcaacggcccggcguccuaccggaucuucaagaucgagaaggggaagaucaccaagucgaucgagcuggacgcccccaacucccacuacgaggagugcagcugcuaccccgacaccggcacggugaugugcgugugccgcgacaacuggcacggguccaaccggcccugggucucguucaaccagaaccucgacuacaagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagucgaacuccagccggaagggguucgagaugaucugggaccccaacggcuggaccgacacggacuccaacuuccuggucaagcaggacgugguggccaugaccgacuggucgggguacagcggcuccuucguccagcacccggagcugaccggccucgacugcaugcgccccugcuucuggguggagcugauccgggggcgcccccgggagaagaccacgaucuggaccucgggcuccagcaucuccuucugcggggucaacagcgacaccgccaacugguccuggcccgacggcgcggagcugccguucaccaucgacaaguga

SEQ ID NO: 17966 - RNA, 1413 nt, Artificial Sequence; identical to SEQ ID NO: 17461
  derived and/or modified CDS sequence (AUadapt) from InfluenzaA__ABK40560__NA

SEQ ID NO: 17967 - RNA, 1413 nt, Artificial Sequence; identical to SEQ ID NO: 17461
  derived and/or modified CDS sequence (AUadapt) from InfluenzaA__ABK40571__NA

SEQ ID NO: 17968 - RNA, 1413 nt, Artificial Sequence; identical to SEQ ID NO: 17461
  derived and/or modified CDS sequence (AUadapt) from InfluenzaA__ABK40582__NA

SEQ ID NO: 17969 - RNA, 1413 nt, Artificial Sequence
  derived and/or modified CDS sequence (AUadapt) from InfluenzaA__ABK40593__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgcccuaccgcgcccugauguccugccccaucggggaggccccgagccccuacaacucccgguucgagucgguggccuggagcgcguccgccugccacgacggcaugggcuggcugacgaucgggaucucgggccccgacgacggggccgucgccgugcucaaguacaacggcaucaucaccgagaccaucaaguccuggcgcaagcggauccugcgcacccaggagagcgagugcgugugcgucaacggcuccugcuucacgaucaugaccgacgggcccucgaacggcccggcgucccaccggaucuucaagaucgagaaggggaagaucaccaagagcaucgagcuggacgcccccaacucccacuacgaggagugcucgugcuaccccgacaccggcacggugaugugcgugugccgcgacaacuggcacggguccaaccggcccugggucagcuucaaccagaaccucgacuacaagaucggcuacaucugcuccggcguguucggggacaacccgcgccccaaggacggcaaggggucgugcgaccccgugaccgucgacggcgccgacggggugaagggcuucuccuaccgguacggcaacgggguguggaucggccgcaccaagagcaacuccucgcggaagggguucgagaugaucugggaccccaacggcuggaccgacacggacuccaacuuccuggucaagcaggacgugguggccaugaccgacuggagcggguacucgggcuccuucguccagcacccggagcugaccggccucgacugcaugcgccccugcuucuggguggagcugauccgggggcgcccccgggagaagaccacgaucuggaccagcggcuccucgaucuccuucugcggggucaacagcgacaccgccaacugguccuggcccgacggcgcggagcugccguucaccaucgacaaguga

SEQ ID NO: 17970 - RNA, 1413 nt, Artificial Sequence; identical to SEQ ID NO: 17461
  derived and/or modified CDS sequence (AUadapt) from InfluenzaA__ABK40604__NA

SEQ ID NO: 17971 - RNA, 1410 nt, Artificial Sequence; identical to SEQ ID NO: 17132
  derived and/or modified CDS sequence (AUadapt) from InfluenzaA__ABK40615__NA

SEQ ID NO: 17972 - RNA, 1410 nt, Artificial Sequence; identical to SEQ ID NO: 16463
  derived and/or modified CDS sequence (AUadapt) from InfluenzaA__ABK40626__NA

SEQ ID NO: 17973 - RNA, 1410 nt, Artificial Sequence
  derived and/or modified CDS sequence (AUadapt) from InfluenzaA__ABK40648__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccggcaagugcuaccaguucgcccuggggcagggcaccacgcugaacaaccgccacagcaacgacaccguccacgaccggaccccguaccgcacccuccugaugaacgagcugggcauccccuuccaccucgggacgaagcaggucugcaucgccugguccucguccagcugccacgacggcaaggcguggcugcacgugugcgugaccgggcacgacgagaacgccaccgccuccuucaucuacgacggccggcugguggacucgaucggguccuggucgaagaacauccuccgcacccaggaguccgagugcgugugcaucaacggcacgugcaccgucgugaugaccgacggcagcgccuccgaccgggcggacaccaagauccuguucaucgaggaggggaagaucgugcacaucucgccccugagcggcuccgcccagcacgucgaggagugcucgugcuacccccgcuacccgggggugcggugcgugugccgcgacaacuggaagggcuccaaccggcccaucgucgacaucaacgugaaggacuacagcaucguguccucguacgucugcuccggccucgugggggacacgccccgcaagaacgacagcuccucguccucguacugcuggaaccccaacaacgagaagggcgggcacggcgugaaggggugggccuucgacgacggcaacgacgucuggaugggccggaccaucuccgaggagagccgcuccggguacgagaccuucaaggugaucggcggguggucgaagccgaacuccaagcugcagaucaaccggcaggucaucguggaccgcggcaaccggagcggguacuccggcaucuucucgguggagggcaagagcugcaucaaccgcugcuucuacgucgagcugauccgggggcgcaagcaggagaccgaggugugguggacguccaacucgaucguggucuucugcggcaccuccgggaccuacggcaccgggagcuggcccgacggcgccgacaucaaccucaugcccaucuga

SEQ ID NO: 17974 - RNA, 1410 nt, Artificial Sequence; identical to SEQ ID NO: 17515
  derived and/or modified CDS sequence (AUadapt) from InfluenzaA__ABK40659__NA

SEQ ID NO: 17975 - RNA, 1410 nt, Artificial Sequence; identical to SEQ ID NO: 17503
  derived and/or modified CDS sequence (AUadapt) from InfluenzaA__ABK40681__NA

SEQ ID NO: 17976 - RNA, 1413 nt, Artificial Sequence
  derived and/or modified CDS sequence (AUadapt) from InfluenzaA__ABK40692__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgguggagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcucgggcguguucggggacaacccccgccccaaggacggcaagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 17977 - RNA, 1410 nt, Artificial Sequence; identical to SEQ ID NO: 17132
  derived and/or modified CDS sequence (AUadapt) from InfluenzaA__ABK40703__NA

SEQ ID NO: 17978 - RNA, 1410 nt, Artificial Sequence; identical to SEQ ID NO: 17132
  derived and/or modified CDS sequence (AUadapt) from InfluenzaA__ABK40714__NA

SEQ ID NO: 17979 - RNA, 1410 nt, Artificial Sequence; identical to SEQ ID NO: 17132
  derived and/or modified CDS sequence (AUadapt) from InfluenzaA__ABK40725__NA

SEQ ID NO: 17980 - RNA, 1410 nt, Artificial Sequence; identical to SEQ ID NO: 17132
  derived and/or modified CDS sequence (AUadapt) from InfluenzaA__ABK40736__NA

SEQ ID NO: 17981 - RNA, 1410 nt, Artificial Sequence; identical to SEQ ID NO: 17847
  derived and/or modified CDS sequence (AUadapt) from InfluenzaA__ABK40747__NA

SEQ ID NO: 17982 - RNA, 1413 nt, Artificial Sequence; identical to SEQ ID NO: 17353
  derived and/or modified CDS sequence (AUadapt) from InfluenzaA__ABK79951__NA

SEQ ID NO: 17983 - RNA, 1413 nt, Artificial Sequence; identical to SEQ ID NO: 17958
  derived and/or modified CDS sequence (AUadapt) from InfluenzaA__ABK79973__NA

SEQ ID NO: 17984 - RNA, 1410 nt, Artificial Sequence; identical to SEQ ID NO: 17132
  derived and/or modified CDS sequence (AUadapt) from InfluenzaA__ABK79984__NA

SEQ ID NO: 17985 - RNA, 1410 nt, Artificial Sequence; identical to SEQ ID NO: 17132
  derived and/or modified CDS sequence (AUadapt) from InfluenzaA__ABK79995__NA

SEQ ID NO: 17986 - RNA, 1413 nt, Artificial Sequence; identical to SEQ ID NO: 17461
  derived and/or modified CDS sequence (AUadapt) from InfluenzaA__ABK80028__NA

SEQ ID NO: 17987 - RNA, 1413 nt, Artificial Sequence; identical to SEQ ID NO: 17461
  derived and/or modified CDS sequence (AUadapt) from InfluenzaA__ABK80039__NA

SEQ ID NO: 17988 - RNA, 1413 nt, Artificial Sequence; identical to SEQ ID NO: 17461
  derived and/or modified CDS sequence (AUadapt) from InfluenzaA__ABK80050__NA

SEQ ID NO: 17989 - RNA, 1410 nt, Artificial Sequence
  derived and/or modified CDS sequence (AUadapt) from InfluenzaA__ABK80061__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccucguccagcucccacugccuggaccccaacaacgaggagggcgggcacggggucaagggcugggccuucgacgacggcaacgacguguggauggggcggaccaucucggagaagucccgcagcggcuacgagaccuucaaggucaucgaggggugguccaagcccaacucgaagcugcagaucaaccgccaggugaucguggaccggggcaaccgguccggguacucgggcaucuucagcgucgagggcaaguccugcaucaaccgcugcuucuacguggagcucauccgggggcgcaagcaggagaccgaggugcuguggaccucgaacuccaucgucguguucugcggcaccagcgggaccuacggcacgggguccuggccggacggcgccgacaucaaccugaugcccaucuga

SEQ ID NO: 17990 - RNA, 1410 nt, Artificial Sequence; identical to SEQ ID NO: 16463
  derived and/or modified CDS sequence (AUadapt) from InfluenzaA__ABK80072__NA

SEQ ID NO: 17991 - RNA, 1410 nt, Artificial Sequence
  derived and/or modified CDS sequence (AUadapt) from InfluenzaA__ABK80083__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcucugcgagcccacgaucaucgagcgcaacaucaccgagaucgucuaccugaccaacaccacgaucgagaaggagaucugccccaagcuggcggaguaccggaacuggagcaagccgcagugcaacaucaccggguucgcccccuucuccaaggacaacucgauccgccucuccgccggcggggacaucugggugacccgggagcccuacgugagcugcgaccccgacaagugcuaccaguucgcccugggccaggggaccacgcugaacaacggccacuccaacgacaccguccacgaccgcaccccguaccggacccuccugaugaacgagcugggcgugcccuuccaccucgggacgaagcaggucugcaucgccuggucguccagcuccugccacgacggcaaggcguggcugcacgugugcgugaccggggacgacgagaacgccaccgccucguucaucuacaacggccgccugguggacuccaucgggucgugguccaagaagauccuccggacccaggagagcgagugcgucugcaucaacggcacgugcaccguggugaugaccgacggcuccgccucggggaaggcggacaccaagauccuguucaucgaggagggcaagaucguccacacgagccugcucuccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcuggugggcgacacgccccgcaagaacgacuccucguccucgucccacugccuggaccccaacaacgaggagggcgggcacggggucaagggcugggccuucgacgacggcaacgacguguggauggggcggaccaucagcgagaagcuccgcuccggcuacgagaccuucaaggucaucgagggguggucgaagcccaacuccaagcugcagaucaaccgccaggugaucguggaccggggcaaccggagcggguacuccggcaucuucucggucgagggcaagagcugcaucaaccgcugcuucuacguggagcugauccgggggcgcaagcaggagaccgaggugcucuggaccuccaacucgaucgucguguucugcggcaccuccgggaccuacggcacggggagcuggccggacggcgccgacaucaaccugaugcccaucuga

SEQ ID NO: 17992 - RNA, 1410 nt, Artificial Sequence
  derived and/or modified CDS sequence (AUadapt) from InfluenzaA__ABK80094__NA
augaaccccaaccagaagaucaucaccaucggcucggugucccugaucaucgccaccaucugcuuccucaugcagaucgccauccuggucacgaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggaccaagcaggucugcaucgccugguccucguccagcugccacgacggcaaggcguggcugcacgugugcgugacgggggacgacgagaacgccaccgccuccuucaucuacaacggccgccugguggacucgaucggguccuggagcaagaagauccuccggacccaggaguccgagugcgucugcaucaacgggaccugcacgguggugaugaccgacggcucggccuccgggaaggcggacaccaagauccuguucaucgaggagggcaagaucguccacaccagcucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccagcuccucgucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaccgaggugcuguggacgucgaacuccaucgucguguucugcgggaccagcggcaccuacgggaccggcuccuggccggacggggccgacaucaaccucaugcccaucuga

SEQ ID NO: 17993 - RNA, 1410 nt, Artificial Sequence; identical to SEQ ID NO: 17132
  derived and/or modified CDS sequence (AUadapt) from InfluenzaA__ABK80105__NA

SEQ ID NO: 17994 - RNA, 1410 nt, Artificial Sequence
  derived and/or modified CDS sequence (AUadapt) from InfluenzaA__ABK80138__NA
augaaccccaaccagaagaucaucaccaucggcucggugucccugaccaucgccacgaucugcuuccucaugcagaccgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacgcaggaguccgagugcgucugcaucaacgggaccugcaccguggugaugaccgacggcagcgccuccgggaaggcggacacgaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 17995 - RNA, 1410 nt, Artificial Sequence
  derived and/or modified CDS sequence (AUadapt) from InfluenzaA__ABK80149__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggcgaugcucuacgagcccacgaucaucgagcgcaacaucaccgagaucguguaccugaccaacaccacgaucgagaaggagaucugccccaagcuggccgaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgcgugguccucguccucgugccacgacggcaaggccuggcugcacgugugcgucaccggggacgacgagaacgccaccgccuccuucaucuacaacggccggcugguggacagcaucggguccuggucgaagaagauccuccgcacccaggaguccgagugcgugugcaucaacggcacgugcaccgucgugaugaccgacggcagcgcguccgggaaggccgacaccaagauccuguucaucgaggagggcaagaucgugcacaucucgacgcugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggaccuacggcacggggagcuggccggacggcgccgacaucaaccugaugcccaucuga

SEQ ID NO: 17996 - RNA, 1410 nt, Artificial Sequence; identical to SEQ ID NO: 17995
  derived and/or modified CDS sequence (AUadapt) from InfluenzaA__ABK80160__NA

SEQ ID NO: 17997 - RNA, 1410 nt, Artificial Sequence
  derived and/or modified CDS sequence (AUadapt) from InfluenzaA__ABK80171__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggagcuccucguccugccacgacggcaaggcguggcugcacgucugcgugaccggggacgacgagaacgccaccgccagcuucaucuacaacggccggcugguggacuccaucgggucgugguccaagaagauccuccgcacccaggagucggagugcgucugcaucaacggcacgugcaccguggugaugaccgacggcuccgccagcgggaaggcggacaccaagauccuguucaucgaggagggcaagaucguccacaucuccacgcugucggggagcgcccagcacguggaggagugcuccugcuacccccgguacccgggcgugcgcugcgucugccgggacaacuggaagggcucgaaccgccccaucguggacaucaacgugaaggacuacuccaucuucagcuccuacgucugcucggggcucgugggcgacacgccccggaagaacgacuccuucucguccagccacugccuggaccccaacaacgaggagggcgggcacggggugaagggcugggccuucgacgacggcaacgacgucuggauggggcgcaccaucuccgagaagcugcggucgggcuacgagaccuucaaggugaucgaggggugguccaagccgaacagcaagcuccagaccaaccgccaggucaucguggagcggggcaaccgcuccggguacucgggcaucuucuccguggagggcaagagcugcaucaaccggugcuucuacgucgagcugauccgcgggcggaaggaggagaccgaggugugguggaccuccaacucgaucguggucuucugcggcaccagcgggacguacggcaccggguccuggcccgacggcgccgacaucaaccugaugcccaucuga

SEQ ID NO: 17998 - RNA, 1410 nt, Artificial Sequence
  derived and/or modified CDS sequence (AUadapt) from InfluenzaA__ABK80182__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggcaagcugguggacagcaucggguccuggucgaagaagauccuccggacccaggaguccgagugcgucugcaucaacggcacgugcgccguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagacggaggugugguggaccagcaacucgaucgucguguucugcggcaccuccgggaccuacggcacggggagcuggccggacggcgccgacaucaaccugaugcccaucuga

SEQ ID NO: 17999 - RNA, 1410 nt, Artificial Sequence
  derived and/or modified CDS sequence (AUadapt) from InfluenzaA__ABK80193__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcagcugcuacccccgguaccccggcgugcgcugcgucugccgggacaacuggaagggcuccaaccgcccgaucguggacaucaacgugaaggacuacucgaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucggcgagaagcugcggagcggguacgagaccuucaaggucaucgagggcugguccaagcccaacucgaagcuccagaccaaccgccaggugaucguggagcgggggaaccgcuccggcuacucgggcaucuucuccgucgagggcaagagcugcaucaaccggugcuucuacguggagcugauccgcgggcggaaggaggagaccgaggugugguggaccuccaacucgaucgucguguucugcgggaccagcggcacguacgggaccggcuccuggccggacggcgccgacaucaaccugaugcccaucuga

SEQ ID NO: 18000 - RNA, 1410 nt, Artificial Sequence
  derived and/or modified CDS sequence (AUadapt) from InfluenzaA__ABK80204__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacgagaacgccaccgccuccuucaucuacaacggcaagcugguggacagcaucggguccuggucgaagaagauccuccggacccaggaguccgagugcgucugcaucaacggcacgugcgccguggugaugaccgacggcucggcguccgggaaggccgacaccaagauccuguucaucgaggagggcaagaucguccacaucagcacccugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacgccuggauggggcggaccaucucggagaagcugcgcuccggcuacgagaccuucaaggugaucgagggguggagcaagcccaacuccaagcuccagaccaaccggcaggucaucguggagcgcggcaaccggucgggguacuccggcaucuucucgguggagggcaaguccugcaucaaccgcugcuucuacgucgagcugauccgggggcgcaaggaggagacggaggugugguggaccagcaacucgaucguggucuucugcggcaccuccgggaccuacggcacggggagcuggccggacggcgcggacaucaaccugaugcccaucuga

SEQ ID NO: 18001 - RNA, 1410 nt, Artificial Sequence; identical to SEQ ID NO: 16993
  derived and/or modified CDS sequence (AUadapt) from InfluenzaA__ABK80215__NA

SEQ ID NO: 18002 - RNA, 1410 nt, Artificial Sequence; identical to SEQ ID NO: 16993
  derived and/or modified CDS sequence (AUadapt) from InfluenzaA__ABK80226__NA

SEQ ID NO: 18003 - RNA, 1410 nt, Artificial Sequence
  derived and/or modified CDS sequence (AUadapt) from InfluenzaA__ABK80237__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaccgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggacguacggcaccgggagcuggccggacggcgccgacaucaaccugaugcccaucuga

SEQ ID NO: 18004 - RNA, 1410 nt, Artificial Sequence
  derived and/or modified CDS sequence (AUadapt) from InfluenzaA__ABK80259__NA
augaaccccaaccagaagaucaucaccaucggcucggccucccugaccaucgccacgaucugcuuccucauccagaucgcgauccuggugaccaccgucacccugcacuucaagcagcacgagugcaacucgccgcccaacaaccaggugaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggaccacgcugaacaacggccacagcaacgacaccgugcacgaccgcaccccguaccggacccuccugaugaacgagcugggcguccccuuccaccucgggacgcgccaggugugcaucgcgugguccucguccucgugccacgacggcaaggccuggcugcacgugugcgucaccggggacgacaagaacgccaccgccuccuucaucuacaacggccggcugguggacagcaucuccucgugguccaagaagauccuccgcacccaggagagcgagugcgugugcaucaacgggacgugcaccgucgugaugaccgacggcuccgcgucgggcaaggccgacaccaagauccuguucaucgaggaggggaagaucauccacaucagcacgcuguccggcucggcccagcacguggaggagugcuccugcuacccccgguaccccgggguccgcugcgugugccgggacaacuggaagggcucgaaccgcccgaucguggacaucaacgucaaggacuacuccaucgugagcuccuacgugugcucgggccucgucggggacacgccccggaagaacgacuccuucagcuccucgcacugccuggaccccaacaacgaggagggcgggcacggcgugaaggggugggccuucgacgacggcaacgacguguggaugggccgcaccaucuccgagaagcugcggucgggguacgagaccuucaaggucaucgagggcugguccaaccccaacagcaagcuccagaucaaccgccaggugaucgucgagcgggggaaccgcuccggcuacucggggaucuucuccguggagggcaagagcugcaucaaccggugcuucuacguggagcugauccgcggccggaaggaggagaccgaggucugguggaccucgaacuccaucgugguguucugcgggaccagcggcaccuacgggacgggcuccuggccggacggggccgacaucaaccugaugcccaucuga

SEQ ID NO: 18005 - RNA, 1410 nt, Artificial Sequence; identical to SEQ ID NO: 16729
  derived and/or modified CDS sequence (AUadapt) from InfluenzaA__ABK80270__NA

SEQ ID NO: 18006 - RNA, 1410 nt, Artificial Sequence; identical to SEQ ID NO: 17116
  derived and/or modified CDS sequence (AUadapt) from InfluenzaA__ABK80281__NA

SEQ ID NO: 18007 - RNA, 1410 nt, Artificial Sequence
  derived and/or modified CDS sequence (AUadapt) from InfluenzaA__ABK80292__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucauccacacgagcacccuguccgggucggcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcucgggccuggugggcgacacgccccgcaagaacgacuccagcuccucgucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcucgaaccgguccggcuacagcgggaucuucucgguggagggcaaguccugcaucaaccgcugcuucuacgucgagcucauccgggggcgcaaggaggagaccgaggugcuguggaccagcaacuccaucguggucuucugcggcaccagcggcacguacgggaccggcuccuggccggacggggccgacaucaaccugaugcccaucuga

SEQ ID NO: 18008 - RNA, 1410 nt, Artificial Sequence
  derived and/or modified CDS sequence (AUadapt) from InfluenzaA__ABK80303__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucuacgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggucgaagaagauccuccgcacccaggaguccgagugcgucugcaucaacggcacgugcaccguggugaugaccgacggcaacgccagcgggaaggcggacaccaagauccuguucaucgaggagggcaagaucguccacaucuccacgcugucggggagcgcccagcacguggaggagugcuccugcuacccccgguaccccggcgugcgcugcgucugccgggacaacuggaagggcucgaaccgcccgaucguggacaucaacgugaaggacuacuccaucgucagcuccuacgugugcucggggcucgugggcgacacgccccggaagaacgacuccuucucguccagccacugccuggaccccaacaacgaggagggcgggcacggggucaagggcugggccuucgacgacggcaacgacguguggauggggcgcaccaucuccgagaagcugcggucgggcuacgagaccuucaaggucaucgaggggugguccaagcccaacagcaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcaccagcgggaccuacggcacgggguccuggccggacggcgccgacaucaaccugaugcccaucuga

SEQ ID NO: 18009 - RNA, 1410 nt, Artificial Sequence
  derived and/or modified CDS sequence (AUadapt) from InfluenzaA__ABK80314__NA
augaaccccaaccagaagaucaucaccaucggcucggugucccugaccaucgccacgaucugcuuccucaugcagaucgccauccuggucaccaccgugacccugcacuucaagcaguacgagugcgacucgccgcccaacaaccaggugaugcucuacgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 18010 - RNA, 1350 nt, Artificial Sequence
  derived and/or modified CDS sequence (AUadapt) from InfluenzaA__ABL07021__NA
augaaucccaaccagaagaucaucaccaucggcucgaucugcauggugaucgggaucgucucccugaugcuccagaucggcaacaugaucagcaucugggugucccacagcauccagaaggggaaccagcaucaggccgaguccaucagcaacaccaacccgcugacggagaaggccguggcguccaucacccuggccggcaacagcucccucugccccauccgcgggugggccguccacucgaaggauaacaacauccggaucggcuccaagggcgacguguucgugauccgcgagcccuucaucagcugcucccaccuggagugucggaccuucuuccugacccagggggcccuccugaacgacaagcacagcaacggcacggucaaggaccgcaguccccaccggacccugaugagcugcccggugggggaggcccccucccccuacaacagccgcuucgaguccguggcguggucggccagugccugccacgacggcaccuccuggcucaccaucgggaucagcggccccgacaacgaggccgucgcggugcugaaguacaacggcaucaucacggauaccaucaaguccuggcggaacaacauccugcgcacccaggagagcgagugcgccugcgugaacggguccugcuucaccgucaugacggauggcccgagcaacgggcaggccuccuacaagaucuucaagaugaagaagggcaagguggugaaguccgucgagcucgacgcccccaacuaccacuaugaggagugcuccugcuaccccgacgccggcgagaucacgugcgugugccgggacaacuggcaugggucgaaccgccccuggguguccuucaaccagaaccuggaguaccagaucggcuacaucugcaguggggucuucggcgacaacccgcggcccaacgacgggaccggcuccugcggccccaugagccccaacggggcguauggcgugaagggguucuccuucaaguacggcaacgggguguggaucggccgcaccaagagcaccaacucccggagcggcuucgagaugaucugggauccgaacggguggaccggcaccgacuccagcuucucggucaagcaggacaucguggccaucaccgacugguccggguacaguggcuccuucgugcagcaccccgagcugacggggcucgacugcauccgccccugcuucugggucgagcugauccggggccgccccaaggagagcaccaucuggaccuccggcagcuccaucaguuucugcggggugaacuccgacaccgucagcugguccuggccggacggcgccgagcugcccuucacgaucgacaaguga

SEQ ID NO: 18011 - RNA, 1350 nt, Artificial Sequence
  derived and/or modified CDS sequence (AUadapt) from InfluenzaA__ABL07032__NA
augaaucccaaccagaagaucaucaccaucggcucgaucugcauggugaucgggaucgucucccugaugcuccagaucggcaacauggugagcaccugggugucccacaguauccagacggggaaccaguaccaggccgaguccaucagcaacaccaacccgcugaccgagaaggccgucgcguccgugacccuggccggcaacaguucccucugccccauccgcgggugggccgugcacagcaaggacaacaacauccggaucggcuccaagggcgaugucuucgugauccgcgagcccuucaucagcugcucccaccuggagugccggacguuuuuccugacccagggggcccuccugaacgacaagcacagcaacggcaccgugaaggaucgcagcccccaccggacccugaugagcugcccggucggggaggcccccucccccuacaacagucgcuucgaguccguggcguggagcgccagcgccugccacgacggcacguccuggcucaccaucgggaucaguggccccgacaacgaggccguggcgguccugaaguacaacggcaucaucaccgacaccaucaaguccuggcggaacaauauccugcgcacgcaggagagcgagugcgccugcgugaacggguccugcuucaccgugaugaccgauggcccgagcaacgggcaggccuccuacaagaucuucaagauggagaagggcaaggucgugaaguccguggagcucgacgcccccaacuaccauuacgaggagugcuccugcuaccccgacgccggcgagaucacgugcgucugucgggacaacuggcacgggagcaaccgccccuggguguccuucaaucagaaccuggaguaccagaucggcuacaucugcagcgggguguucggcgauaacccgcggcccaacgacgggaccggcuccugcggccccaugagccccaacggggcguauggcgucaagggguucuccuucaaguacggcaacgggguguggaucggccgcaccaagagcaccaacucccggaguggcuucgagaugaucugggacccgaacggguggaccggcacggacuccagcuucagugugaagcaggacaucgucgccaucaccgacugguccggguacagcggcuccuucgugcagcaccccgagcugaccgggcucgauugcauccgccccugcuucugggucgagcugauccggggccgccccaaggagagcaccaucuggacguccggcagcuccaucagcuuuugcggggugaacuccgacaccgugagcugguccuggccggacggcgccgagcugcccuucaccaucgacaaguga

SEQ ID NO: 18012 - RNA, 1350 nt, Artificial Sequence
  derived and/or modified CDS sequence (AUadapt) from InfluenzaA__ABL31746__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggcguccgucacccuggccggcaacagcucccucugucccauccgcgggugggccgugcacagcaaggacaacaacauccggaucggcuccaagggcgacguguucgucauccgcgagcccuuuaucagcugcucccaccuggagugccggaccuucuuccugacgcagggggcccuccugaacgauaagcacagcaacggcaccgugaaggaccgcagcccccaccggacccugauguccugcccggugggggaggcccccucccccuauaacucgcgcuucgaguccgucgcguggagcgccagcgccugccacgauggcaacuccuggcucaccaucgggaucagcggccccgacaacgaggccguggcggugcugaaguacaacggcaucaucacggacaccaucaaguccuggcggaagaauauccugcgcacccaggagagcgagugcgccugcgucaacggguccugcuucaccgugaugacggacggcccgaguaacgggcaggccuccuacaagaucuucaagauggagaagggcaagguggucaagagcguggagcucgacgcccccaacuaccauuacgaggagugcuccugcuaccccgacgccggcgagaucacgugcgugugccgggauaacuggcacgggagcaaccgccccugggucuccuucaaccagaaccuggaguaucagaucggcuacaucugcagcgggguguucggcgacaacccgcggcccaacgaugggaccggcuccugcggccccaugucgcccaacggggcguacggcgugaagggguucuccuucaaguacggcaauggggucuggaucggccgcaccaagagcaccaacucccggagcggcuucgagaugaucugggacccgaacggguggaccggcaccgacuccaguuucagcgugaagcaggacaucguggccaucaccgacugguccggguacagcggcuccuucguccagcaucccgagcugacggggcucgacugcauccgccccugcuucuggguggagcugauccggggccgccccaaggagagcaccaucuggaccuccggcagcuccaucagcuuuugcggggucaacuccgacaccgugagcugguccuggccggacggcgccgagcugcccuucacgaucgacaaguga

SEQ ID NO: 18013 - RNA, 1350 nt, Artificial Sequence
  derived and/or modified CDS sequence (AUadapt) from InfluenzaA__ABL31757__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggcguccgucacccuggccggcaacagcucccucugucccauccgcgggugggccgugcacagcaaggacaacaacauccggaucggcuccaagggcgacguguuugucauccgcgagcccuucaucagcugcucccaccuggagugccggaccuucuuccugacgcagggggcccuccugaaugacaagcacagcaacggcaccgugaaggaccgcagcccccaucggacccugauguccugcccggugggggaggcccccucccccuacaacagccgcuucgaguccgucgcguggagcgccagcgccugucacgacggcaccuccuggcucacgaucgggaucagcggccccgacaacgaggccguggcggugcugaaguacaauggcaucaucaccgacaccaucaaguccuggcggaacaacauccugcgcacccaggagagcgagugcgccugcgucaacggguccuguuucacggugaugaccgacggcccgucgaacgggcaggccuccuacaagaucuucaagauggagaagggcaagguggucaagaguguggagcucgacgcccccaacuaccacuacgaggagugcuccugcuaucccgacgccggcgagaucacgugcgugugccgggacaacuggcacgggaguaaccgccccugggucuccuucaaccagaaccuggaguaccagaucggcuacaucugcagugggguguucggcgacaacccgcggcccaacgacgggaccggcuccugcggccccaugagucccaacggggcguacggcgugaagggguucuccuucaaguacggcaacggggucuggaucggccgcaccaagagcaccaauucccggagcggcuucgagaugaucugggacccgaacggguggaccggcaccgacuccagcuuuagcgugaagcaggacaucguggccaucacggacugguccggguacagcggcuccuucguccagcaccccgagcugaccgggcucgauugcauccgccccugcuucuggguggagcugauccggggccgccccaaggagagcaccaucuggaccuccggcagcuccaucagcuuuugcggggucaacuccgacacggugagcugguccuggccggacggcgccgagcugcccuucaccaucgacaaguga

SEQ ID NO: 18014 - RNA, 1350 nt, Artificial Sequence; identical to SEQ ID NO: 18013
  derived and/or modified CDS sequence (AUadapt) from InfluenzaA__ABL31768__NA

SEQ ID NO: 18015 - RNA, 1410 nt, Artificial Sequence; identical to SEQ ID NO: 16993
  derived and/or modified CDS sequence (AUadapt) from InfluenzaA__ABL67168__NA

SEQ ID NO: 18016 - RNA, 1410 nt, Artificial Sequence; identical to SEQ ID NO: 17132
  derived and/or modified CDS sequence (AUadapt) from InfluenzaA__ABL67179__NA

SEQ ID NO: 18017 - RNA, 1413 nt, Artificial Sequence; identical to SEQ ID NO: 17958
  derived and/or modified CDS sequence (AUadapt) from InfluenzaA__ABL67190__NA

SEQ ID NO: 18018 - RNA, 1410 nt, Artificial Sequence
  derived and/or modified CDS sequence (AUadapt) from InfluenzaA__ABL67201__NA
augaaccccaaccagaagaucaucaccaucucguccgugagccugaccaucuccacgaucugcuucuucaugcagaucgccauccucaucaccaccgucacccugcacuucaagcaguacgaguucaacucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggcuucgcgcccuucagcaaggacaacuccauccgccugagcgccgggggcgacaucugggucacccgggagcccuacguguccugcgaccccgacaagugcuaccaguucgcccucgggcagggcaccacgcugaacaacgugcacucgaacgacaccguccacgaccgcaccccguaccggacccugcucaugaacgagcugggggugcccuuccaccugggcacgaagcaggucugcaucgccugguccagcuccucgugccacgacggcaaggccuggcuccacgugugcgugaccggggacgacaagaacgcgaccgccuccuucaucuacaacggccgccugguggacagcaucgucuccuggagcaagaagauccugcggacccaggaguccgagugcgugugcaucaacgggacgugcaccguggucaugaccgacggcucggccagcgggaaggccgacaccaagauccucuucaucgaggagggcaagaucgugcacacguccacccugucgggcuccgcgcagcacguggaggagugcagcugcuacccccgcuaccccgggguccggugcgugugccgcgacaacuggaagggcuccaaccggccgaucguggacaucaacaucaaggacuacagcaucgucuccucguacgugugcuccgggcuggugggcgacacgccccgcaagaacgacagcuccucguccagccacugccucgaccccaacaacgaggagggcgggcacggcgucaaggggugggccuucgacgacggcaacgacguguggauggggcggaccaucuccgagaagcugcgcagcggcuacgagaccuucaaggucaucgagggcugguccaaccccaacucgaagcugcagaucaaccgccaggugaucguggaccgggggaaccgguccggcuacagcgggaucuucucggucgagggcaaguccugcaucaaccgcugcuucuacguggagcucauccgggggcgcaaggaggagaccgaggugcuguggaccagcaacuccaucgucguguucugcggcaccagcggcacguacgggaccggcuccuggccggacggggccgacaucaaccugaugcccaucuga

SEQ ID NO: 18019 - RNA, 1413 nt, Artificial Sequence; identical to SEQ ID NO: 17958
  derived and/or modified CDS sequence (AUadapt) from InfluenzaA__ABL67212__NA

SEQ ID NO: 18020 - RNA, 1413 nt, Artificial Sequence; identical to SEQ ID NO: 17461
  derived and/or modified CDS sequence (AUadapt) from InfluenzaA__ABL67256__NA

SEQ ID NO: 18021 - RNA, 1413 nt, Artificial Sequence; identical to SEQ ID NO: 17461
  derived and/or modified CDS sequence (AUadapt) from InfluenzaA__ABL67267__NA

SEQ ID NO: 18022 - RNA, 1410 nt, Artificial Sequence; identical to SEQ ID NO: 16463
  derived and/or modified CDS sequence (AUadapt) from InfluenzaA__ABL67278__NA

SEQ ID NO: 18023 - RNA, 1410 nt, Artificial Sequence
  derived and/or modified CDS sequence (AUadapt) from InfluenzaA__ABL67289__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucuacgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 18024 - RNA, 1410 nt, Artificial Sequence
  derived and/or modified CDS sequence (AUadapt) from InfluenzaA__ABL67300__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaacauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggaccacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 18025 - RNA, 1410 nt, Artificial Sequence; identical to SEQ ID NO: 16582
  derived and/or modified CDS sequence (AUadapt) from InfluenzaA__ABL67311__NA

SEQ ID NO: 18026 - RNA, 1410 nt, Artificial Sequence
  derived and/or modified CDS sequence (AUadapt) from InfluenzaA__ABL67322__NA
augaaccccaaccagaagaucaucaccaucggcucggugucccugaccaucgccacgaucugcuuccucaugcagaucgccauccuggucaccaccgugacccugcacuucaagcaguacgagugcaacccgccgcccaacaaccaggugaugcucugcgagcccacgaucaucgagcgcaacaucaccgagaucgucuaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgugucgugcgacccggacaagugcuaccaguucgcccugggccaggggaccacgcugaacaacggccacuccaacgacaccguccacgaccgcacccccuaccggacccuccugaugaacgagcugggcgugcccuuccaccucgggacgcgccaggugugcaucgccuggucguccagcuccugccacgacggcaaggcguggcugcacgucugcgugaccggggacgacgagaacgccaccgccucguucaucuacaacggccggcugguggacuccaucgggucgugguccaagaagauccuccgcacccaggagagcgagugcgucugcaucaacggcacgugcaccguggugaugaccgacggcuccgccucggggaaggcggacaccaagauccuguucaucgaggagggcaagaucguccacacguccacccugucggggagcgcccagcacguggaggagugcuccugcuacccccgguacccgggcgugcgcugcgucugccgggacaacuggaagggcucgaaccgccccaucguggacaucaacgugaaggacuacuccaucgucucguccuacgugugcagcgggcucgugggcgacacgccccggaagaacgacuccuucucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagccgaacucgaagcuccagaccaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcacgagcgggaccuacggcaccggguccuggcccgacggcgccgacaucaaccugaugcccaucuga

SEQ ID NO: 18027 - RNA, 1410 nt, Artificial Sequence
  derived and/or modified CDS sequence (AUadapt) from InfluenzaA__ABL67333__NA
augaaccccaaccagaagaucaucaccaucggcucggugucccugaccaucgccacgaucugcuuccucaugcagaucgccauccuggucaucaccgugacccugcacuucaagcaguacgagugcaacucgccgcccaacaaccaggugaugcucugcgagcccaccaucaucgagcgcaacaucacggagaucgucuaccugaccaacaccaccaucgagaaggagaucugccccaagcuggcggaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgccugguccucguccagcugccacgacggcaaggcguggcugcacgucugcgugacgggggacgacgagaacgccaccgccuccuucaucuacaacggcaagcugguggacucgaucggguccuggagcaagaagauccuccggacccaggaguccgagugcgucugcaucaacgggaccugcgccguggugaugacggacggcucggcguccgggaaggccgacaccaagauccuguucaucgaggagggcaagaucguccacaucagcacccugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcggccacggggucaagggcugggccuucgacgacggcaacgacguguggauggggcggaccaucagcgagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 18028 - RNA, 1410 nt, Artificial Sequence; identical to SEQ ID NO: 16993
  derived and/or modified CDS sequence (AUadapt) from InfluenzaA__ABL67344__NA

SEQ ID NO: 18029 - RNA, 1410 nt, Artificial Sequence
  derived and/or modified CDS sequence (AUadapt) from InfluenzaA__ABL67355__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgagaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccagcugccacgacggcaaggccuggcugcacgugugcgugaccggggacgacaagaacgcgaccgccuccuucaucuacaacggccgccuggucgacucgaucggguccuggagcaagaagauccuccggacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgcuaccccggcguccggugcgugugccgcgacaacuggaagggcuccaaccggccgaucguggacaucaacgucaaggacuacagcaucguguccucguacgugugcuccgggcucgucggcgacacgccccgcaagaacgacagcuucuccucgucccacugccuggaccccaacaacgaggagggcgggcacggggugaagggcugggccuucgacgacggcaacgacgucuggauggggcggaccaucagcgagaagcugcgcuccggcuacgagaccuucaaggugaucgagggguggucgaagcccaacuccaagcuccagaucaaccgccaggugaucgucgagcggggcaaccggagcggguacuccggcaucuucucgguggagggcaaguccugcaucaaccgcugcuucuacguggagcugauccgggggcgcaaggaggagaccgaggucugguggaccagcaacucgaucgugguguucugcggcaccuccgggaccuacggcacggggagcuggccggacggcgccgacaucaaccugaugcccaucuga

SEQ ID NO: 18030 - RNA, 1410 nt, Artificial Sequence
  derived and/or modified CDS sequence (AUadapt) from InfluenzaA__ABL67366__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacacccggauccuguucaucgaggagggcaagaucguccacaucucgacgcugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggaccuacggcacggggagcuggccggacggcgccgacaucaaccugaugcccaucuga

SEQ ID NO: 18031 - RNA, 1410 nt, Artificial Sequence
  derived and/or modified CDS sequence (AUadapt) from InfluenzaA__ABL67377__NA
augaaccccaaccagaagaucaucaccaucggcucggccucccugaccaucgccaucaucugcuuccucauccagaucgcgauccuggugacgaccgucacccugcacuucaagcagcacgagugcaacucgccgcccaacaaccaggugaugcucugcgagcccaccaucaucgagcgcaacaucacggagaucguguaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggucacccgggagcccuacguguccugcgaccccgacaagugcuaccaguucgcccugggccaggggaccacccugaacaacggccacagcaacgacacggugcacgaccgcaccccguaccggacccuccugaugaacgagcugggcguccccuuccaccucgggacccgccaggugugcaucgcgugguccucguccagcugccacgacggcaaggccuggcugcacgugugcgucacgggggacgacaagaacgccaccgccuccuucaucuacaacggccggcugguggacucgaucuccagcugguccaagaagauccuccgcacccaggagucggagugcgugugcaucaacgggaccugcacggucgugaugaccgacggcuccgcgagcggcaaggccgacaccaagauccuguucaucgaggaggggaagaucauccacaucucgacccuguccggcucggcccagcacguggaggagugcuccugcuacccccgguaccccgggguccgcugcgugugccgggacaacuggaagggcagcaaccgcccgaucguggacaucaacgucaaggacuacuccaucgugucguccuacgugugcagcggccucgucggggacacgccccggaagaacgacuccuucucguccagccacugccuggaccccaacaacgaggagggcgggcacggcgugaaggggugggccuucgacgacggcaacgacguguggaugggccgcaccaucuccgagaagcugcggucgggguacgagaccuucaaggucaucgagggcugguccaaccccaacagcaagcuccagaucaaccgccaggugaucgucgagcgggggaaccgcuccggcuacucggggaucuucuccguggagggcaagagcugcaucaaccggugcuucuacguggagcugauccgcggccggaaggaggagaccgaggucugguggacgucgaacuccaucgugguguucugcgggaccagcggcaccuacgggaccggcuccuggccggacggggccgaccugaaccucaugcccaucuga

SEQ ID NO: 18032 - RNA, 1410 nt, Artificial Sequence; identical to SEQ ID NO: 16729
  derived and/or modified CDS sequence (AUadapt) from InfluenzaA__ABL67388__NA

SEQ ID NO: 18033 - RNA, 1410 nt, Artificial Sequence; identical to SEQ ID NO: 16729
  derived and/or modified CDS sequence (AUadapt) from InfluenzaA__ABL67399__NA

SEQ ID NO: 18034 - RNA, 1410 nt, Artificial Sequence; identical to SEQ ID NO: 17114
  derived and/or modified CDS sequence (AUadapt) from InfluenzaA__ABL67410__NA

SEQ ID NO: 18035 - RNA, 1410 nt, Artificial Sequence
  derived and/or modified CDS sequence (AUadapt) from InfluenzaA__ABL67421__NA
augaaccccaaccagaagaucaucaccaucggcucgaucucccugaccaucagcacgaucugcuucuucaugcagaucgccauccucaucaccaccgugacccugcacuucaagcaguacgaguucaacuccccgcccaacaaccaggucaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgugagcugguccaaggagauccugcggacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 18036 - RNA, 1350 nt, Artificial Sequence
  derived and/or modified CDS sequence (AUadapt) from InfluenzaA__ABL67772__NA
augaaucccaacaagaagaucaucaccaucggcucgaucugcauggugaccgggauggucucccugaugcuccagaucggcaaccugaucagcaucugggugucccacagcauccacacggggaaucagcacaaggccgagccgaucuccaacaccaacuuccugaccgagaaggccguggcgagcgucaagcucgccggcaacuccagccugugccccaucaaugggugggccguguacuccaaggacaacagcauccgcaucggcuccaagggcgacguguucgucauccgggagcccuucaucagcuguucccaccuggagugccgcaccuucuuccucacgcagggggcccugcugaacgacaagcacucgaauggcaccgugaaggaccggagcccccaccgcacccucauguccugcccggugggggaggcccccucccccuacaacagccgguucgaguccgucgcguggagugccagcgccugccacgacggcaccuccuggcugacgaucgggaucagcggccccgacaacggcgccguggcggugcugaaguacaaugggaucaucaccgacaccaucaaguccuggcgcaacaacauccuccggacccaggagagcgagugcgccugcgucaacggcuccugcuuuacggugaugaccgacgggccgucgaacggccaggccucccacaagaucuucaagauggagaagggcaagguggucaagagcguggagcuggacgcccccaacuaccauuacgaggagugcuccugcuaccccgacgccggggagaucacgugcgugugccgcgacaauuggcacggcagcaaccggcccugggucuccuucaaccagaaccugaaguaccagaucggguacaucuguagcggcguguucggggacaacccgcgccccaacgacggcaccggcuccugcgggcccgugagcuccaauggcgcguacggggucaagggcuucagcuucaaguacgggaacggcguguggaucggccggaccaaguccaccaacagccgcuccggguuugagaugaucugggaccccaacggcuggaccgagaccgacucgagcuucuccgugaagcaggacaucgucgccaucacggacuggaguggguacuccggcagcuucgugcagcacccggagcucaccgggcuggacugcauccggcccugcuucugggucgagcugauccgcggccggcccaaggaguccaccaucuggaccaguggcuccagcaucuccuucugcggggugaacagcgacacggugggcugguccuggcccgacggggccgagcucccguucaccaucgacaaguga

SEQ ID NO: 18037 - RNA, 1350 nt, Artificial Sequence
  derived and/or modified CDS sequence (AUadapt) from InfluenzaA__ABL67783__NA
augaaucccaacaagaagaucaucaccaucggcucgaucugcauggugaccgggauggucucccugaugcuccagaucggcaaccugaucagcaucugggugucccacagcauccauacggggaaccagcacaaggccgagccgaucuccaacaccaacuuccugaccgagaaggccguggcgagcgucaagcucgccggcaacuccagucugugccccaucaacgggugggccguguacuccaaggacaacagcauccgcaucggcuccaagggcgacguguuugucauccgggagcccuucaucagcugcucccaccuggagugccgcaccuucuuccucacgcagggggcccugcugaaugacaagcacagcaacggcaccgugaaggaccggagcccccaccgcacccucauguccuguccggugggggaggcccccucccccuacaacagccgguucgaguccgucgcguggagcgccagcgccugccaugacggcaccuccuggcugacgaucgggaucagcggccccgacuccggcgccguggcggugcugaaguacaacgggaucaucaccgacaccaucaagagcuggcgcaauaacauccuccggacccaggaguccgagugcgccugcgucaacggcucgugcuucacggugaugaccgaugggccguccaacggccaggccagccacaagaucuucaagauggagaagggcaagguggucaaguccguggagcuggacgcccccaacuaccauuacgaggagugcagcugcuaccccgacgccggggagaucacgugcgugugucgcgacaacuggcacggcuccaaccggcccugggucagcuucaaccagaaucuggaguaccagaucggguacaucugcuccggcguguucggggacaacccgcgccccaacgauggcaccggcagcugcgggcccguguccagcaacggcgcguacggggucaagggcuucuccuucaaguaugggaacggcguguggaucggccggaccaagagcaccaacucccgcagcggguucgagaugaucugggaccccaacggcuggaccgagaccgauagcuccuucagcgugaagcaggacaucgucgccaucacggacugguccggguacagcggcuccuuugugcagcacccggagcucaccgggcuggacugcauccggcccugcuucugggucgagcugauccgcggccggcccaaggagagcaccaucuggaccuccggcagcuccaucaguuucugcggggugaacuccgacacggugggcuggagcuggcccgacggggccgagcucccguucaccaucgacaaguga

SEQ ID NO: 18038 - RNA, 1350 nt, Artificial Sequence
  derived and/or modified CDS sequence (AUadapt) from InfluenzaA__ABL67796__NA
augaaucccaacaagaagaucaucaccaucggcucgaucugcauggugaccgggauggucucccugaugcuccagaucggcaaccugaucagcaucugggugucccacagcauccacacggggaaucagcacaaggccgagccgaucuccaacaccaacuuccugaccgagaaggccguggcgagcgucaagcucgccggcaacuccagccugugccccaucaaugggugggccguguacuccaaggacaacagcauccgcaucggcuccaagggcgacguguucgucauccgggagcccuucaucagcuguucccaccuggagugccgcaccuucuuccucacgcagggggcccugcugaacgacaagcacucgaauggcaccgugaaggaccggagcccccaccgcacccucauguccugcccggugggggaggcccccucccccuacaacagccgguucgaguccgucgcguggagcgccagugccugccacgacggcaccuccuggcugacgaucgggaucagcggccccgacaacggcgccguggcggugcugaaguacaacgggaucaucaccgauaccaucaaguccuggcgcaacaacauccuccggacccaggagagcgagugcgccugcgucaacggcuccugcuucacggugaugaccgaugggccgucgaacggccaggccucccacaagaucuucaagauggagaagggcaagguggucaagagcguggagcuggacgcccccaacuaccauuacgaggagugcuccugcuaccccgacgccggggagaucacgugcgugugccgcgacaauuggcacggcagcaaccggcccugggucuccuucaaccagaaccuggaguaccagaucggguacaucugcaguggcguguucggggacaacccgcgccccaacgacggcaccggcuccugcgggcccgugagcuacaauggcgcguacggggucaagggcuucuccuucaaguacgggaacggcguguggaucggccggaccaagagcaccaacucccgcagcggguuugagaugaucugggaccccaacggcuggaccgagaccgacuccucguucagcgugaagcaggacaucgucgccaucacggacugguccggguauagcggcuccuucgugcagcacccggagcucaccgggcuggacugcauccggcccugcuucugggucgagcugauccgcggccggcccaaggagagcaccaucuggaccuccggcaguuccaucagcuucugcggggugaacuccgacacggugggcuggagcuggcccgacggggccgagcucccguucaccaucgacaaguga

SEQ ID NO: 18039 - RNA, 1350 nt, Artificial Sequence
  derived and/or modified CDS sequence (AUadapt) from InfluenzaA__ABL67807__NA
augaaucccaacaagaagaucaucaccaucggcagcaucugcauggugaccgggauggucucccugaugcuccagaucggcaaccugaucagcaucugggugucccauagcauccacacggggaaccagcacaaggccgagccgaucuccaacaccaaccugcucaccgagaaggccguggcgagugucaagcuggccggcaacuccagccugugccccaucgacgggugggccguguacuccaaggacaauagcauccgcaucggcuccaagggcgacguguucgucgugcgggagcccuucaucagcugcucccaucucgagugccgcaccuucuuccugacgcagggggcccugcucaacgacaagcacaguaacggcaccgugaaggaccggagcccccaccgcacccugaugagcuguccggucggggaggcccccucccccuacaacagccgguucgaguccguggcguggagcgccagcgccugucacgacggcaccuccuggcugacgaucgggaucagcggccccgacaacggcgccguggcgguccucaaguacaaugggaucaucaccgacaccaucaaguccuggcgcaacaacauccugcggacccaggagagcgagugcgccugcgugaauggcuccugcuucacggugaugaccgacgggccgagcaacggccaggccucccacaagaucuuuaagauggagaagggcaaggucgugaaguccguggagcuggacgcccccaacuaccacuacgaggaguguuccugcuaccccgacgccggggagaucacgugcgucugccgcgacaauuggcacggcagcaaccggcccuggguguccuucaaccagaaccucgaguaucagaucggguacaucugcagcggcguguucggggacaacccgcgccccaaugacggcgcgggcuccugcgggcccgucagcuccaacggcgccuacggggugaagggcuucaguuucaaguacgggaacggcguguggaucggccggaccaaguccaccaacagccgcuccggguuugagaugaucugggaccccaacggcuggaccgagaccgacagcagcuucuccgucaagcaggauaucguggccaucaccgacuggagcggguacuccggcagcuucguccagcacccggagcugacggggcuggauugcauccggcccugcuucuggguggagcucauccgcggccggcccaaggaguccaccaucuggaccagcggcuccagcaucuccuucuguggggugaacagcgacaccgucggcugguccuggcccgacggggccgagcugccguucacgaucgacaaguga

SEQ ID NO: 18040 - RNA, 1350 nt, Artificial Sequence
  derived and/or modified CDS sequence (AUadapt) from InfluenzaA__ABL67818__NA
augaaucccaacaagaagaucaucaccaucggcucgaucugcauggugaccgggauggucucccugaugcuccagaucggcaaccugaucagcaucugggugucccacaguauccacacggggaaccagcacaaggccgagccgaucuccaacaccaaccugcucaccgagaaggccguggcgagcgucaagcuggccggcaauuccagccugugccccaucgacgggugggccguguacuccaaggacaacaguauccgcaucggcuccaagggcgacguguucgucgugcgggagcccuucaucagcugcucccaccucgagugucgcaccuucuuccugacgcagggggcccugcucaacgacaagcacagcaacggcaccgugaaggaucggagcccccaccgcacccugauguccugcccggucggggaggcccccucccccuacaacagccgguuugaguccguggcguggagcgccagcgccugccacgacggcaccuccuggcugacgaucgggaucagcggccccgauaacggcgccguggcgguccucaaguacaacgggaucaucaccgacaccaucaaguccuggcgcaacaacauccugcggacccaggagagugagugcgccugcgugaacggcuacugcuucacggugaugaccgaugggccguccaacggccaggccagccacaagaucuucaagauggagaagggcaaggucgugaaguccguggagcuggacgcccccaacuaccauuacgaggagugcagcugcuaccccgacgccggggagaucacgugugucugccgcgacaacuggcacggcuccaaccggcccugggugagcuuuaaccagaaccucgaguaccagaucggguacaucugcuccggcguguucggggauaacccgcgccccaacgacggcgcgggcagcugcgggcccgucuccagcaauggcgccuacggggugaagggcuucuccuucaaguacgggaacggcguguggaucggccggaccaagagcaccaacucccgcaguggguucgagaugaucugggaccccaacggcuggaccgagaccgacuccagcuucagugucaagcaggacaucguggccaucaccgacugguccggguacagcggcuccuucguccagcacccggagcugacggggcuggauugcauccggcccugcuucuggguggagcucauccgcggccggcccaaggagagcaccaucuggaccuccggcagcuccaucagcuuuugcggggugaacuccgacaccgucggcuggagcuggcccgacggggccgagcugccguucacgaucgacaaguga

SEQ ID NO: 18041 - RNA, 1350 nt, Artificial Sequence
  derived and/or modified CDS sequence (AUadapt) from InfluenzaA__ABL67829__NA
augaaucccaacaagaagaucaucaccaucggcagcaucugcauggugaccgggauggucucccugaugcuccagaucggcaaccugaucagcaucugggugucccacaguauccacacggggaaccagcacaaggccgagccgaucuccaacaccaaccugcucaccgagaaggccguggcgagcgucaagcuggccggcaauuccagccugugccccaucaacgggugggccguguacuccaaggacaacaguauccgcaucggcuccaagggcgacguguucgucgugcgggagcccuucaucagcugcucccaccucgagugucgcaccuucuuccugacgcagggggcccugcucaacgacaagcacagcaauggcaccgugaaggaccggagcccccaccgcacccugauguccugcccggucggggaggcccccucccccuacaacagucgguucgaguccguggcguggagcgccagcgccugccacgacggcaccuccuggcugacgaucgggaucagcggccccgauaacggcgccguggcgguccucaaguacaacgggaucaucaccgacaccaucaaguccuggcgcaacaacauccugcggacccaggagagugagugcgccugcgugaacggcuucugcuucacggugaugaccgaugggccguccaacggccaggccagccacaagaucuucaagauggagaagggcaaggucgugaaguccguggagcuggacgcccccaacuaucacuacgaggagugcagcugcuaccccgaugccggggagaucacgugcgucugccgcgacaacuggcacggcuccaaccggcccugggugaguuucaaccagaaccucgaguaccagaucggguacaucugcuccggcguguucggggauaacccgcgccccaacgacggcgcgggcagcugcgggcccgucgccuccaacggcgccuauggggugaagggcuucagcuucaaguacgggaacggcguguggaucggccggaccaaguccaccaacagucgcuccggguucgagaugaucugggaccccaacggcuggaccgagaccgacagcuccuucagugucaagcaggacaucguggccaucaccgacuggagcggguacuccggcagcuucguccagcauccggagcugacggggcuggacugcauccggcccugcuucuggguggagcucauccgcggccggcccaaggaguccaccaucuggaccagcggcuccagcaucuccuuuugcggggugaacagcgacaccgucggcugguccuggcccgacggggccgagcugccguucacgaucgacaaguga

SEQ ID NO: 18042 - RNA, 1410 nt, Artificial Sequence; identical to SEQ ID NO: 17114
  derived and/or modified CDS sequence (AUadapt) from InfluenzaA__ABM22018__NA

SEQ ID NO: 18043 - RNA, 1413 nt, Artificial Sequence; identical to SEQ ID NO: 17958
  derived and/or modified CDS sequence (AUadapt) from InfluenzaA__ABM22029__NA

SEQ ID NO: 18044 - RNA, 1410 nt, Artificial Sequence; identical to SEQ ID NO: 17116
  derived and/or modified CDS sequence (AUadapt) from InfluenzaA__ABM22040__NA

SEQ ID NO: 18045 - RNA, 1410 nt, Artificial Sequence; identical to SEQ ID NO: 18023
  derived and/or modified CDS sequence (AUadapt) from InfluenzaA__ABM22062__NA

SEQ ID NO: 18046 - RNA, 1410 nt, Artificial Sequence
  derived and/or modified CDS sequence (AUadapt) from InfluenzaA__ABM22073__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuucaaccucgggacgcgccaggugugcaucgccugguccucguccucgugccacgacggcaaggcguggcugcacgucugcgugaccggggacgacgagaacgccaccgccuccuucaucuacaacggcaagcugguggacagcaucggguccuggucgaagaagauccuccggacccaggaguccgagugcgucugcaucaacggcacgugcgccguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagacggaggugugguggaccagcaacucgaucgucguguucugcggcaccuccgggaccuacggcacggggagcuggccggacggcgccgacaucaaccugaugcccaucuga

SEQ ID NO: 18047 - RNA, 1410 nt, Artificial Sequence; identical to SEQ ID NO: 16993
  derived and/or modified CDS sequence (AUadapt) from InfluenzaA__ABM22084__NA

SEQ ID NO: 18048 - RNA, 1410 nt, Artificial Sequence
  derived and/or modified CDS sequence (AUadapt) from InfluenzaA__ABM22095__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggcgaugcucugcgagcccacgaucaucgagcgcaacaucaccgagaucgugcaccugaccaacaccacgaucgagaaggagaucugccccaagcuggucgaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggagcggggcaaccgcucgggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 18049 - RNA, 1410 nt, Artificial Sequence; identical to SEQ ID NO: 16993
  derived and/or modified CDS sequence (AUadapt) from InfluenzaA__ABM22106__NA

SEQ ID NO: 18050 - RNA, 1410 nt, Artificial Sequence; identical to SEQ ID NO: 16993
  derived and/or modified CDS sequence (AUadapt) from InfluenzaA__ABM22117__NA

SEQ ID NO: 18051 - RNA, 1410 nt, Artificial Sequence; identical to SEQ ID NO: 18004
  derived and/or modified CDS sequence (AUadapt) from InfluenzaA__ABM22128__NA

SEQ ID NO: 18052 - RNA, 1410 nt, Artificial Sequence
  derived and/or modified CDS sequence (AUadapt) from InfluenzaA__ABM22139__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcgagaaggccgacaccaagauccucuucaucgaggagggcaagaucgugcacacgucgacccuguccggcagcgcgcagcacguggaggagugcuccugcuacccccgcuaccccgggguccggugcgugugccgcgacaacuggaagggcucgaaccggccgaucguggacaucaacaucaaggacuacuccaucgucagcuccuacgugugcucggggcuggugggcgacacgccccgcaagaacgacuccagcuccagcucccacugccucgaccccaacaacgaggagggcgggcacggcgucaaggggugggccuucgacgacggcaacgacguguggauggggcggaccaucucggagaagcugcgcuccggcuacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcucauccgggggcgcaaggaggagaccgaggugcuguggaccuccaacagcaucgucguguucugcggcaccuccggcacguacgggaccggcagcuggccggacggggccgacaucaaccugaugcccaucuga

SEQ ID NO: 18053 - RNA, 1410 nt, Artificial Sequence
  derived and/or modified CDS sequence (AUadapt) from InfluenzaA__ABM22150__NA
augaaccccaaccagaagaucaucaccaucggcucggugucccugaccaucagcacgaucugcuucuucaugcagaucgccauccucaucaccaccgucacccugcacuucaagcaguacgaguucaacucccugccgaacaaccaggugaugcucugcgagcccacgaucaucgagcgcaacaucaccgagaucguguaccugaccaacaccacgaucgagaaggagaucugccccgagcuggccgaguaccggaacuggucgaagccccagugcgacaucaccggguucgcgccguucuccaaggacaacagcauccgccucuccgccggcggggacaucugggucacccgggagcccuacgugagcugcgaccccgacaagugcuaccaguucgcccugggccaggggaccacgcugaacaacgugcacuccaacgacaccguccacgaccgcacccccuaccggacccuccugaugaacgagcugggcgugccguuccaccucggcacgaagcaggucugcaucgccuggucguccagcuccugccacgacgggaaggccuggcugcacgugugcgugaccggcgacgacaagaacgcgaccgccucguucaucuacaacgggcgccugguggacuccaucgucagcugguccaagaagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcucgggccucgugggcgacaccccgcgcaagaacgacuccagcuccucgucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggcccgacggcgccgacaucaaccucaugccgaucuga

SEQ ID NO: 18054 - RNA, 1413 nt, Artificial Sequence; identical to SEQ ID NO: 17461
  derived and/or modified CDS sequence (AUadapt) from InfluenzaA__ABM22161__NA

SEQ ID NO: 18055 - RNA, 1413 nt, Artificial Sequence; identical to SEQ ID NO: 17461
  derived and/or modified CDS sequence (AUadapt) from InfluenzaA__ABM22172__NA

SEQ ID NO: 18056 - RNA, 1413 nt, Artificial Sequence; identical to SEQ ID NO: 17461
  derived and/or modified CDS sequence (AUadapt) from InfluenzaA__ABM22183__NA

SEQ ID NO: 18057 - RNA, 1413 nt, Artificial Sequence; identical to SEQ ID NO: 17461
  derived and/or modified CDS sequence (AUadapt) from InfluenzaA__ABM22194__NA

SEQ ID NO: 18058 - RNA, 1413 nt, Artificial Sequence; identical to SEQ ID NO: 17461
  derived and/or modified CDS sequence (AUadapt) from InfluenzaA__ABM22205__NA

SEQ ID NO: 18059 - RNA, 1413 nt, Artificial Sequence; identical to SEQ ID NO: 17461
  derived and/or modified CDS sequence (AUadapt) from InfluenzaA__ABM22216__NA

SEQ ID NO: 18060 - RNA, 1413 nt, Artificial Sequence; identical to SEQ ID NO: 17461
  derived and/or modified CDS sequence (AUadapt) from InfluenzaA__ABM22227__NA

SEQ ID NO: 18061 - RNA, 1413 nt, Artificial Sequence; identical to SEQ ID NO: 17461
  derived and/or modified CDS sequence (AUadapt) from InfluenzaA__ABM22238__NA

SEQ ID NO: 18062 - RNA, 1413 nt, Artificial Sequence
  derived and/or modified CDS sequence (AUadapt) from InfluenzaA__ABM22271__NA
augaaccccaaccagaagaucaucaccaucggcucgaucuccaucgugaucgggaucaucagccugauccuccagaucggcaacaucaucuccaucugggccucgcacuccauccagaccgggagccagaaccacacgggcaucugcaaccagcgcaucaucaccuacgagaacuccaccugggucaaccagaccuacgugaacaucaacaacacgaacguggucgccgggaaggacaagaccucgaugacccuggcgggcaacuccagccugugcccgauccggggcugggccaucuacaccaaggacaacuccauccgcaucgggucgaagggcgacguguucgugauccgggagcccuucaucuccugcagccaccucgagugccgcacguucuuccugacccagggggcccugcucaacgacaagcacuccaacggcaccgucaaggaccggucgcccuaccgcgcccugauguccugcccccugggggaggccccgagccccuacaacucccgguucgagucgguggcguggagcgccuccgccugccacgacggccucggcuggcugaccaucgggaucucgggccccgacaacggggccguggcgguccugaaguacaacggcaucaucacggagaccaucaaguccuggaagaagcgcauccuccggacccaggagagcgagugcgugugcaugaacggcuccugcuucaccaucaugacggacgggcccucgaacggcgccgccuccuaccgcaucuucaagaucgagaaggggcgggugaccaagagcaucgagcugggcgccccgaacuaccacuacgaggagugcuccugcuaccccgacaccgggaccgucaugugcgugugccgcgacaacuggcacggcucgaaccggcccuggguguccuucaaccagaaccuggacuaccagaucggcuacaucugcagcggggucuucggcgacaacccccgcccgaaggacggggagggcuccugcaaccccgugacgguggacggggccgacggcgucaagggcuucucguaccgguacgggaacggcguguggaucgggcgcaccaaguccaaccggcuccgcaagggcuucgagaugaucugggaccccaacggguggaccgacaccgacagcgacuucuccaugaagcaggacaucguggcgaugacggacuggucgggcuacuccggcagcuucguccagcaccccgagcugaccgggcuggacugcaugcggccgugcuucuggguggagcucgugcgcggccugccccgggagaacaccaccaucuggacgucgggguccagcaucuccuucugcggcgucaacagcgacaccgccaacugguccuggcccgacggcgccgagcugcccuucaccaucgacaaguga

SEQ ID NO: 18063 - RNA, 1413 nt, Artificial Sequence; identical to SEQ ID NO: 17370
  derived and/or modified CDS sequence (AUadapt) from InfluenzaA__ABM22282__NA

SEQ ID NO: 18064 - RNA, 1410 nt, Artificial Sequence; identical to SEQ ID NO: 16745
  derived and/or modified CDS sequence (AUadapt) from InfluenzaA__ABM22304__NA

SEQ ID NO: 18065 - RNA, 1410 nt, Artificial Sequence; identical to SEQ ID NO: 16745
  derived and/or modified CDS sequence (AUadapt) from InfluenzaA__ABM22315__NA

SEQ ID NO: 18066 - RNA, 1410 nt, Artificial Sequence; identical to SEQ ID NO: 16745
  derived and/or modified CDS sequence (AUadapt) from InfluenzaA__ABM22326__NA

SEQ ID NO: 18067 - RNA, 1410 nt, Artificial Sequence; identical to SEQ ID NO: 16745
  derived and/or modified CDS sequence (AUadapt) from InfluenzaA__ABM22337__NA

SEQ ID NO: 18068 - RNA, 1410 nt, Artificial Sequence; identical to SEQ ID NO: 16748
  derived and/or modified CDS sequence (AUadapt) from InfluenzaA__ABM22348__NA

SEQ ID NO: 18069 - RNA, 1410 nt, Artificial Sequence; identical to SEQ ID NO: 16748
  derived and/or modified CDS sequence (AUadapt) from InfluenzaA__ABM22359__NA

SEQ ID NO: 18070 - RNA, 1410 nt, Artificial Sequence; identical to SEQ ID NO: 16748
  derived and/or modified CDS sequence (AUadapt) from InfluenzaA__ABM22370__NA

SEQ ID NO: 18071 - RNA, 1413 nt, Artificial Sequence; identical to SEQ ID NO: 17327
  derived and/or modified CDS sequence (AUadapt) from InfluenzaA__ABM66867__NA

SEQ ID NO: 18072 - RNA, 1413 nt, Artificial Sequence; identical to SEQ ID NO: 17461
  derived and/or modified CDS sequence (AUadapt) from InfluenzaA__ABM66900__NA

SEQ ID NO: 18073 - RNA, 1413 nt, Artificial Sequence; identical to SEQ ID NO: 17461
  derived and/or modified CDS sequence (AUadapt) from InfluenzaA__ABM66911__NA

SEQ ID NO: 18074 - RNA, 1410 nt, Artificial Sequence; identical to SEQ ID NO: 16748
  derived and/or modified CDS sequence (AUadapt) from InfluenzaA__ABM66922__NA

SEQ ID NO: 18075 - RNA, 1410 nt, Artificial Sequence; identical to SEQ ID NO: 16748
  derived and/or modified CDS sequence (AUadapt) from InfluenzaA__ABM66933__NA

SEQ ID NO: 18076 - RNA, 1410 nt, Artificial Sequence; identical to SEQ ID NO: 16748
  derived and/or modified CDS sequence (AUadapt) from InfluenzaA__ABM66944__NA

SEQ ID NO: 18077 - RNA, 1410 nt, Artificial Sequence; identical to SEQ ID NO: 16748
  derived and/or modified CDS sequence (AUadapt) from InfluenzaA__ABM66955__NA

SEQ ID NO: 18078 - RNA, 1410 nt, Artificial Sequence; identical to SEQ ID NO: 16748
  derived and/or modified CDS sequence (AUadapt) from InfluenzaA__ABM66966__NA

SEQ ID NO: 18079 - RNA, 1410 nt, Artificial Sequence; identical to SEQ ID NO: 16748
  derived and/or modified CDS sequence (AUadapt) from InfluenzaA__ABM66977__NA

SEQ ID NO: 18080 - RNA, 1410 nt, Artificial Sequence; identical to SEQ ID NO: 16748
  derived and/or modified CDS sequence (AUadapt) from InfluenzaA__ABM66988__NA

SEQ ID NO: 18081 - RNA, 1410 nt, Artificial Sequence; identical to SEQ ID NO: 16748
  derived and/or modified CDS sequence (AUadapt) from InfluenzaA__ABM66999__NA

SEQ ID NO: 18082 - RNA, 1410 nt, Artificial Sequence; identical to SEQ ID NO: 16748
  derived and/or modified CDS sequence (AUadapt) from InfluenzaA__ABM67010__NA

SEQ ID NO: 18083 - RNA, 1410 nt, Artificial Sequence; identical to SEQ ID NO: 16748
  derived and/or modified CDS sequence (AUadapt) from InfluenzaA__ABM67021__NA

SEQ ID NO: 18084 - RNA, 1413 nt, Artificial Sequence
  derived and/or modified CDS sequence (AUadapt) from InfluenzaA__ABM67054__NA
augaaccccaaccagaagaucaucaccaucggcucgaucuccaucgccaucgggaccaucagccugaugcuccagaucggcaacaugaucuccaucugggccucgcacuccauccagacggggagccagaaccacaccggcaucugcaaccagcgcaucaucaccuacgagaacuccaccugggugaaccacacguacgucaacaucaacaacaccaacgugguggcggggaaggacaagaccucggucacccuggccggcaacuccagccugugcuccaucucgggcugggccaucuacacgaaggacaacuccauccggaucgggagcaagggcgacguguucgugauccgcgagccguucaucuccugcucgcaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccucgaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucucguacaaguacggcaacgggguguggaucggccggaccaaguccaaccgccugcggaagggguucgagaugaucugggaccccaacggcuggaccgacacggacagcgacuucuccgucaagcaggacgugguggccaucaccgacuggucgggguacagcggcuccuucguccagcaccccgagcucaccggccuggacugcauccgccccugcuucuggguggagcugguccgggggcucccgcgcgagaacaccacgaucuggaccucgggcuccagcaucuccuucugcgggguggacagcgacaccgccaacugguccuggcccgacggcgccgagcugcccuucaccaucgacaaguga

SEQ ID NO: 18085 - RNA, 1350 nt, Artificial Sequence
  derived and/or modified CDS sequence (AUadapt) from InfluenzaA__ABM68048__NA
augaaucccaaccaaaagaucaucaccaucggcagcaucugcauggugaucgggaucgucucccugaugcuccagaucggcaacaucaucagcaucuggaucucccacagcauccagaccgggaaccagugucaggccggcccgaucuccaacacgaaguuccugaccgagaaggccguggcgagcgugacccuggccgggaacuccagccucugccccaucuccggcugggccgucuacagcaaggauaacuccauccgcaucggcagccgcggggacguguucgugauccgggaauccuucaucagcugcucccaccuggagugucggaccuucuuccugacgcagggcgcccuccugaacgacaagcacagcaacgggaccgucaaggaccgcaguccccaccggacccugaugagcugccccgugggcgaggccccgucccccuacaacagccgcuucgagagcguggcgugguccgccagugccugccacgacgggaccuccuggcucacgaucggcaucagcggccccgacaacggggccgucgcggugcugaaguacaacggcaucaucaccgauaccaucaaguccuggcggaacaacauccugcgcacccaggaaagcgagugcgccugcgugaacggguccugcuucacggucaugaccgauggccccagcaacggccaggccuccuacaagaucuucaagauggagaaggggaagguggugaaguccgucgagcucgacgccccgaacuaccacuaugaagagugcuccugcuaccccgacgccggcgagaucacgugcgugugccgggacagcuggcauggguccaaccgccccugggugagcuucaaccagaaccuggaguaccagaucggcuacaucugcuccggggucuuuggcgacaacccccggccgaacgacggcaccgggagcugcggccccgugucccccaacggggcguacggcgugaagggguuuagcuucaaguacggcaacggcgucuggaucgggcgcaccaaguccaccaacagccggagcggcuucgagaugaucugggaucccaacggguggaccggcaccgacuccagcuucuccgugaaacaggacaucguggccaucacggacuggagcggguacuccggcaguuucguccagcacccggagcugaccggccucgacugcauccgccccugcuucuggguggagcugauccgggggcgccccaaggaguccaccaucuggaccagcggcuccagcaucuccuuuugcggggucaacagcgacacgguguccuggagcuggcccgacggcgccgagcugccguucaccaucgacaaguga

SEQ ID NO: 18086 - RNA, 1350 nt, Artificial Sequence
  derived and/or modified CDS sequence (AUadapt) from InfluenzaA__ABM68049__NA
augaaucccaaccaaaagaucaucaccaucggcagcaucugcauggugaucgggaucgucucccugaugcuccagaucggcaacaucaucagcaucuggaucucccacagcauccagaccgggaaucagugccaggccgagccgaucuccaacacgaaguuccugaccgaaaaggccguggcgagcgugacccuggccggcaacuccagccucugccccaucuccgggugggccgucuacaguaaggacaacuccauccgcaucggcagccggggcgacguguucgugauccgcgagcccuucaucuccugcagccaucuggagugccggaccuucuuccugacgcagggggcccuccugaacgacaagcacuccaacggcaccgucaaggaccgcaguccccaccggacccugauguccugcccggugggggaggcccccagccccuacaacucccgcuucgaaagcguggcguggagcgccuccgccugucacgacggcaccagcuggcucacgaucgggaucuccggccccgacaacggcgccgucgcggugcugaaguacaacgggaucaucaccgacaccaucaagaguuggcggaacaacauccugcgcacccaggaguccgagugcgccugcgugaacggcagcugcuucacggucaugaccgaugggccguccagcggccaggccuccuacaagaucuucaaaauggagaagggcaagguggucaagagcguggagcucgacgcccccaacuaccacuaugaggagugcuccugcuaccccgacgccggggagaucacgugcgugugccgggacagcuggcauggcuccaaccgccccugggugagcuucaaccaaaaccuggaguaccagaucggguacaucugcuccggcgucuuuggggacaacccgcggcccaacgacggcaccggcagcugcgggcccgugucccccaacggcgcguacggggugaagggcuuuagcuucaaguacgggaacggcgucuggaucggccgcaccaaguccaccaacagccggagcggguucgagaugaucugggauccgaacggcuggaccgggaccgacuccagcuucuccgugaagcaagacaucguggccaucacggacuggagcggcuacuccgggaguuucguccagcaccccgagcugaccggccucgacugcauccgccccugcuucuggguggagcugauccggggccgccccaaggaguccaccaucuggaccagcggguccagcaucuccuuuugcggcgucaacagcgacacgguguccuggagcuggccggacggggccgagcugcccuucaccaucgacaaguga

SEQ ID NO: 18087 - RNA, 1350 nt, Artificial Sequence
  derived and/or modified CDS sequence (AUadapt) from InfluenzaA__ABM90436__NA
augaaucccaaccagaagaucaucaccaucggcucgaucugcauggugaucgggaucgucucccugaugcuccagaucggcaacaugaucagcaucugggugucccacagcauccagaaggggaaucagcaccaggccgaguccaucagcaacaccaacccgcugacggagaaggccguggcguccgucacccuggccggcaacagcucccucugccccauccgcgggugggccgugcauagcaaggacaacaacauccggaucggcuccaagggcgacguguucgucauccgcgagcccuucaucagcuguucccaccuggagugccggaccuucuuccugacccagggggcccuccugaacgacaagcacaguaacggcacggugaaggaccgcagcccccaccggacccugauguccugcccggugggggaggcccccucccccuacaacagccgcuuugaguccgucgcguggagcgccagcgccugccacgacggcaccuccuggcucaccaucgggaucagcggccccgacaaugaggccguggcggugcugaaguacaacggcaucaucacggacaccaucaaguccuggcggaacaacauccugcgcacccaggagagcgagugcgccugcgucaauggguccugcuucaccgugaugacggacggcccgucgaacgggcaggccuccuacaagaucuucaagaugaagaagggcaagguggucaagaguguggagcucgacgcccccaacuaccacuacgaggagugcuccugcuaucccgacgccggcgagaucacgugcgugugccgggacaacuggcacgggagcaaccgccccugggucuccuuuaaccagaaccuggaguaccagaucggcuacaucugcagcgggguguucggcgauaacccgcggcccaacgacgggaccggcuccugcggccccaugagccccaacggggcguacggcgugaagggguucuccuuuaaguacggcaacggggucuggaucggccgcaccaagagcaccaacucccggagcggcuucgagaugaucugggacccgaauggguggaccggcaccgacuccucguucagcgugaagcaggacaucguggccaucaccgacugguccggguacagcggcuccuuuguccagcaccccgagcugacggggcucgacugcauccgccccugcuucuggguggagcugauccggggccgccccaaggagagcaccaucuggaccuccggcagcuccaucaguuucugcggggucaacuccgacaccgugagcugguccuggccggacggcgccgagcugcccuucacgaucgacaaguga

SEQ ID NO: 18088 - RNA, 1350 nt, Artificial Sequence; identical to SEQ ID NO: 18087
  derived and/or modified CDS sequence (AUadapt) from InfluenzaA__ABM90447__NA

SEQ ID NO: 18089 - RNA, 1350 nt, Artificial Sequence; identical to SEQ ID NO: 18087
  derived and/or modified CDS sequence (AUadapt) from InfluenzaA__ABM90458__NA

SEQ ID NO: 18090 - RNA, 1350 nt, Artificial Sequence; identical to SEQ ID NO: 18087
  derived and/or modified CDS sequence (AUadapt) from InfluenzaA__ABM90469__NA

SEQ ID NO: 18091 - RNA, 1350 nt, Artificial Sequence
  derived and/or modified CDS sequence (AUadapt) from InfluenzaA__ABM90491__NA
augaaucccaaccagaagaucaucaccaucggcucgaucugcauggugaucgggaucgucucccugaugcuccagaucggcaacaugaucagcaucugggugucccacagcauccagaaggggaaccagcaucaggccgaguccaucagcaacaccaacccgcugacggagaaggccguggcguccgucacccuggccggcaacucgucccucugccccauccgcgggugggccgugcacagcaaggacaauaacauccggaucggcuccaagggcgacguguucgucauccgcgagcccuucaucagcugcucccaccuggagugccggaccuuuuuccugacccagggggcccuccugaacgacaagcacagcaacggcacggugaaggaccgcagcccccaccggacccugauguccuguccggugggggaggcccccucccccuacaacucgcgcuucgaguccgucgcguggagcgccagcgccugccacgacggcaccuccuggcucaccaucgggaucaguggccccgacaacgaggccguggcggugcugaaguacaacggcaucaucacggacaccaucaaguccuggcggaacaacauccugcgcacccaggagagcgagugugccugcgucaacggguccugcuucaccgugaugacggacggcccgucgaacgggcaggccuccuacaagaucuucaagaugaagaagggcaaggugaucaagagugucgagcucgacgccaccaacuaccacuacgaggagugcuccugcuaccccgacgccggcgagaucacgugugugugccgggacaacuggcacgggagcaaccgccccuggguguccuucaaccagaaucuggaguaccagaucggcuacaucugcagcggggucuucggcgacaacccccggccgaacgacgggaccggcuccuguggccccaugucgcccaacggggcguacggcgugaagggguucuccuucaaguacggcaacgggguguggaucggccgcaccaagagcaccaacucccggaguggcuucgagaugaucugggaccccaacggguggaccggcaccgacuccagcuucagcgucaagcaggacaucguggccaucacggauugguccggguacucgggcuccuucgugcagcacccggagcugaccgggcucgacugcauccgccccugcuucugggucgagcugauccggggccgccccaaggagagcaccaucuggaccuccggcaguuccaucagcuucugcggggugaacuccgacacggucagcugguccuggcccgacggcgccgagcugccguucaccaucgacaaguga

SEQ ID NO: 18092 - RNA, 1350 nt, Artificial Sequence; identical to SEQ ID NO: 18091
  derived and/or modified CDS sequence (AUadapt) from InfluenzaA__ABM90502__NA

SEQ ID NO: 18093 - RNA, 1350 nt, Artificial Sequence
  derived and/or modified CDS sequence (AUadapt) from InfluenzaA__ABM90524__NA
augaaucccaaccagaagaucaucaccaucggcucgaucugcauggugaucgggaucgucucccugaugcuccagaucggcaacaugaucagcaucugggugucccacaguauccagaccgggaaccagcaccaggccgaguccaucagcaacacgaacccgcugaccgagaaggccguggucuccgugacccuggcgggcaacagcucccucugucccauccgcgggugggccgugcacagcaaggacaacaacauccggaucggcuccaagggcgacgucuucgugauccgcgagcccuuuaucagcugcucccaccuggagugccggaccuucuuccugacgcagggggcccuccugaacgauaagcacagcaacggcaccgugaaggaccgcagcccccaccggacccugaugagcuguccggucggggaggcccccucccccuacaacagccgcuucgaguccguggccuggagcgcgagcgccugccaugacggcaccuccuggcucacgaucgggaucagcggccccgacaacgaggccguggccguccugaaguacaacggcaucaucaccgacaccaucaaguccuggcggaauaacauccugcgcacccaggagucggagugcgcgugcgugaacggguccugcuucacggugaugaccgauggcccgagcaacgggcaggccuccuacaagaucuucaagauggagaagggcaaggucgugaaguccguggagcucgacgcccccaacuaccauuacgaggagugcuccugcuaccccgacgccggcgagaucacgugcgucugccgggauaacuggcacgggagcaaccgccccuggguguccuucaaccagaaccuggaguaucagaucggcuacaucugcagcgggguguucggcgacaacccgcggcccaacgaugggaccggcuccugcggccccaugagccccaacggggccuacggcgucaagggguucuccuucaaguacggcaaugggguguggaucggccgcaccaagagcaccaacucccggagcggcuucgagaugaucugggacccgaacggguggaccggcaccgacuccaguuucagcgugaagcaggacaucgucgcgaucacggacugguccggguacagcggcuccuucgugcagcaucccgagcugaccgggcucgacugcauccgccccugcuucugggucgagcugauccggggccgccccaaggagagcaccaucuggaccuccggcagcuccaucagcuuuugcggggugaacuccgacacggugagcugguccuggccggacggcgccgagcugcccuucaccaucgacaaguga

SEQ ID NO: 18094 - RNA, 1350 nt, Artificial Sequence; identical to SEQ ID NO: 18093
  derived and/or modified CDS sequence (AUadapt) from InfluenzaA__ABM90535__NA

SEQ ID NO: 18095 - RNA, 1350 nt, Artificial Sequence; identical to SEQ ID NO: 18093
  derived and/or modified CDS sequence (AUadapt) from InfluenzaA__ABM90546__NA

SEQ ID NO: 18096 - RNA, 1413 nt, Artificial Sequence
  derived and/or modified CDS sequence (AUadapt) from InfluenzaA__ABN50759__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacagcauccgcaucggguccaagggcgacguguucgugauccgggagcccuucaucucgugcucccaccucgagugccgcacguucuuccugacccagggggcccugcucaacgacaagcacagcaacggcaccgucaaggaccggucccccuaccgcgcccugaugucgugccccaucggggaggccccgucccccuacaacagccgguucgagagcguggcgugguccgccucggccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcucgugcuucaccaucaugacggacgggcccuccgacggccaggccagcuaccgcaucuucaagaucgagaaggggaagaucaccaaguccaucgagcuggacgccccgaacagccacuacgaggagugcuccugcuaccccgacaccggcaccgucaugugcgugugccgggacaacuggcacgggucgaaccgccccuggguguccuucaaccagaaccucgacuaccagaucggcuacaucugcagcggcgucuucggggacaacccccggccgaaggacggcaagggguccugcgaccccgugaacguggacggcgccgacggggucaagggcuucucguaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggucgggguacuccggcagcuucgugcagcaccccgagcugacgggccucgacugcauccggccgugcuucugggucgagcugauccgcgggcggccccgcgagaagaccaccaucuggaccuccggcucguccaucagcuucugcggggugaacuccgacacggucaacuggagcuggcccgacggcgcggagcugcccuucaccaucgacaaguga

SEQ ID NO: 18097 - RNA, 1410 nt, Artificial Sequence
  derived and/or modified CDS sequence (AUadapt) from InfluenzaA__ABN50770__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccgucgugagcugguccaagaagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 18098 - RNA, 1413 nt, Artificial Sequence
  derived and/or modified CDS sequence (AUadapt) from InfluenzaA__ABN50903__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacucgucccugugcccggugcggggcugggccaucuacagcaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugccccaucggggaggccccgucgcccuacaacucccgguucgagagcgucgcguggucggccuccgccugccacgacggcaugggcuggcugaccaucgggaucagcggccccgacgacggggccguggcggugcucaaguacaacggcaucaucacggagaccaucaaguccuggcgcaagcggauccugcgcacccaggagagcgagugcgucugcgugaacggcuccugcuucaccaucaugacggacgggcccucgaacggcccggccuccuaccggaucuucaagaucgagaaggggaagaucaccaagagcaucgagcuggacgcccccaacucccacuacgaggagugcucgugcuaccccgacaccggcaccgugaugugcgucugccgcgacaacuggcacggguccaaccggcccugggugagcuucaaccagaaccucgacuaccagaucggcuacaucugcuccggcguguucggggacaacccgcgccccaaggacggcaaggggucgugcggccccgucacgguggacggggccgacggcgugaagggcuucuccuaccgguacgggaacggcgucuggaucgggcgcaccaagagcaacuccagccggaagggcuucgagaugaucugggaccccaacggguggaccgacaccgacuccaacuuccuggugaagcaggacguggucgccaugacggacuggucgggcuacagcggcuccuucauccagcacccggagcugaccgggcucgacugcaugcgccccugcuucuggguggagcugauccggggccgcccccgggagaagaccaccaucuggacgucgggguccagcaucuccuucugcggcgucaacagcgacaccgugaacugguccuggcccgacggcgcggagcugccguucaccaucgacaaguga

SEQ ID NO: 18099 - RNA, 1413 nt, Artificial Sequence; identical to SEQ ID NO: 17461
  derived and/or modified CDS sequence (AUadapt) from InfluenzaA__ABN50920__NA

SEQ ID NO: 18100 - RNA, 1413 nt, Artificial Sequence
  derived and/or modified CDS sequence (AUadapt) from InfluenzaA__ABN50931__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaccuucuuccugacgcagggggcccugcucaacgacaagcacucgaacggcaccgugaaggaccgcucccccuaccgggcccugaugagcugccccaucggggaggcgccgucccccuacaacucgcgcuucgagagcguggccugguccgccagcgccugccacgacggcaugggcuggcugaccaucgggaucuccggccccgacgacggggcggucgccgugcucaaguacaacggcaucaucaccgagacgaucaagucguggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagucgaucgagcuggacgcccccaacucccacuacgaggagugcagcugcuaccccgacgccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagucgaacuccagccggcgcggcuucgagaugaucugggaccccaacggguggacggacaccgacuccaaguuccuggucaagcaggacgugguggccaucaccgacuggucgggcuacagcggcuccuucguccagcacccggagcugaccgggcucgacugcaugcggcccugcuucuggguggagcugauccgcggccggccccgcgagaacacgaccaucuggaccucgggguccagcaucuccuucugcggcgucaacggcgacaccgccaacuggagcuggcccgacggggccgagcugccguucacgaucgacaaguga

SEQ ID NO: 18101 - RNA, 1413 nt, Artificial Sequence
  derived and/or modified CDS sequence (AUadapt) from InfluenzaA__ABN50943__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaccuucuuccugacgcagggggcccugcucaacgacaagcacucgaacggcaccgugaaggaccgcucccccuaccgggcccugaugagcugccccaucggggaggcgccgucccccuacaacucgcgcuucgagagcguggccugguccgccagcgccugccacgacggcaugggcuggcugaccaucgggaucuccggccccgacgacggggcggucgccgugcucaaguacaacggcaucaucaccgagacgaucaagucguggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagucgaucgagcuggacgcccccaacucccacuacgaggagugcagcugcuaccccgacgccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagucgaacuccagccggcgcggcuucgagaugaucugggaccccaacggguggacggacaccgacuccaaguuccuggucaagcaggacgugguggccaugaccgacuggucgggcuacagcggcuccuucguccagcacccggagcugaccgggcucgacugcaugcggcccugcuucuggguggagcugauccgcggccggccccgcgagaacacgaccaucuggaccucgggguccagcaucuccuucugcggcgucaacggcgacaccgccaacuggagcuggcccgacggggccgagcugccguucacgaucgacaaguga

SEQ ID NO: 18102 - RNA, 1413 nt, Artificial Sequence; identical to SEQ ID NO: 17370
  derived and/or modified CDS sequence (AUadapt) from InfluenzaA__ABN50954__NA

SEQ ID NO: 18103 - RNA, 1413 nt, Artificial Sequence; identical to SEQ ID NO: 17370
  derived and/or modified CDS sequence (AUadapt) from InfluenzaA__ABN50965__NA

SEQ ID NO: 18104 - RNA, 1413 nt, Artificial Sequence; identical to SEQ ID NO: 17370
  derived and/or modified CDS sequence (AUadapt) from InfluenzaA__ABN50976__NA

SEQ ID NO: 18105 - RNA, 1410 nt, Artificial Sequence; identical to SEQ ID NO: 16745
  derived and/or modified CDS sequence (AUadapt) from InfluenzaA__ABN50987__NA

SEQ ID NO: 18106 - RNA, 1410 nt, Artificial Sequence; identical to SEQ ID NO: 16748
  derived and/or modified CDS sequence (AUadapt) from InfluenzaA__ABN50998__NA

SEQ ID NO: 18107 - RNA, 1410 nt, Artificial Sequence
  derived and/or modified CDS sequence (AUadapt) from InfluenzaA__ABN51013__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccucugccuggaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 18108 - RNA, 1410 nt, Artificial Sequence
  derived and/or modified CDS sequence (AUadapt) from InfluenzaA__ABN51024__NA
augaaccccaaccagaagaucaucaccaucggcucggugucccugaccgucagcacgaucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugucgugguccaaggagauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggacuacuccaucgugucguccuacgugugcagcggccuggucggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaccaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcacguccgggaccuacggcaccgggagcuggccggacggcgccgacaucaaccugaugcccaucuga

SEQ ID NO: 18109 - RNA, 1410 nt, Artificial Sequence
  derived and/or modified CDS sequence (AUadapt) from InfluenzaA__ABN51035__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccgucgugagcugguccaaggacauccugcggacccaggagucggagugcgugugcaucaacggcacgugcaccgucgugaugaccgacggguccgccagcggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaagaacuacuccaucgugucguccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 18110 - RNA, 1410 nt, Artificial Sequence; identical to SEQ ID NO: 18109
  derived and/or modified CDS sequence (AUadapt) from InfluenzaA__ABN51046__NA

SEQ ID NO: 18111 - RNA, 1413 nt, Artificial Sequence
  derived and/or modified CDS sequence (AUadapt) from InfluenzaA__ABN51069__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugcccccugggggaggcgccgucgcccuacaacucccgguucgagagcgucgccuggucggccuccgccugccacgacggccucggcuggcugaccaucgggaucagcggccccgacaacggggcgguggccgugcugaaguacaacggcaucaucacggagaccaucaaguccuggaagaagcgcauccuccggacccaggagucggagugcgucugcaugaacggcuccugcuucaccaucaugacggacgggcccagcaacggcgccgccuccuaccgcaucuucaagaucgagaaggggcgggugaccaagucgaucgagcuggacgccccgaacuaccacuacgaggagugcuccugcuaccccgacaccggcaccgugaugugcgucugccgcgacaacuggcacgggagcaaccggcccuggguguccuucaaccagaaccuggacuaccagaucggcuacaucugcucgggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguucgagauggugugggaccccaacggcuggaccgacaccgacucggacuucuccaugaagcaggacaucguggccaugacggacuggagcggguacuccggcucguucguccagcaccccgagcugaccggccuggacugcaugcggccgugcuucuggguggagcucgugcgcgggcugccccgggagaacaccaccaucuggacgagcggcuccucgaucuccuucugcggggucaacagcgacaccgccaacugguccuggcccgacggcgccgagcugcccuucaccaucgacaaguga

SEQ ID NO: 18112 - RNA, 1413 nt, Artificial Sequence
  derived and/or modified CDS sequence (AUadapt) from InfluenzaA__ABN51080__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggagaaggacaagaccucggucacccuggccgggaacuccagccugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcgcacccaggagucggagugcgugugcgugaacggcuccugcuucaccaucaugacggacggccccagcaacggggccgccuccuacaagaucuucaagaucgagaagggcaaggucaccaagucgguggagcucaacgcccccaacuuccacuacgaggagugcuccugcuacccggacaccgggaccgugaugugcgucugccgggacaacuggcacggcagcaaccgccccuggguguccuucaaccagaaccuggacuaccagaucggguacaucugcucgggcguguucggcgacaacccccggcccaaggacggggagggcuccugcaacccggucacgguggacggggcgaacggcgugaagggguucagcuacaaguacggcaacggcgucuggaucgggcgcaccaaguccaaccggcugcgcaagggcuucgagaugaucugggaccccaacggguggaccgacaccgacagcgacuucuccgugaagcaggacguggucgccaucacggacuggucgggcuacagcggguccuucgugcagcaccccgagcucaccggccuggacugcauccggcccugcuucugggucgagcuggugcgcggccucccgaaggagaacaccaccaucuggacgucgggguccagcaucuccuucugcggcgugaacagcgacaccgccaacugguccuggcccgacggggccgagcugcccuucaccaucgacaaguga

SEQ ID NO: 18113 - RNA, 1413 nt, Artificial Sequence; identical to SEQ ID NO: 16788
  derived and/or modified CDS sequence (AUadapt) from InfluenzaA__ABN51091__NA

SEQ ID NO: 18114 - RNA, 1410 nt, Artificial Sequence; identical to SEQ ID NO: 16337
  derived and/or modified CDS sequence (AUadapt) from InfluenzaA__ABN51102__NA

SEQ ID NO: 18115 - RNA, 1410 nt, Artificial Sequence; identical to SEQ ID NO: 16505
  derived and/or modified CDS sequence (AUadapt) from InfluenzaA__ABN51113__NA

SEQ ID NO: 18116 - RNA, 1410 nt, Artificial Sequence
  derived and/or modified CDS sequence (AUadapt) from InfluenzaA__ABN51124__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcgucccgcaccggacgcugcugaugaacgagcucggcgugcccuuccaccuggggacccgccaggugugcaucgccuggucguccucguccugccacgacggcaaggcguggcugcacgucugcaucaccggggacgacaagaacgccaccgccagcuucaucuacgacggccggcucguggacuccaucgggucguggucccagaacauccugcgcacgcaggagagcgagugcgugugcaucaacgggaccugcaccgucgugaugaccgacggcuccgccucgggccgggcggacacgcgcauccuguucaucgaggagggcaagaucgugcacaucucgccccucuccgggagcgcccagcacgucgaggagugcuccugcuacccccgguacccgggcgugcgcugcaucugccgggacaacuggaagggcucgaaccgccccguggucgacaucaacauggaggacuacuccaucgacagcuccuacgugugcucggggcuggugggcgacacgccccggaacgacgaccgcuccucgaacuccaacugccggaaccccaacaacgagcgcgggaaccagggcgucaaggggugggccuucgacaacggcgacgacguguggaugggccggaccaucagcaaggaccugcgcuccggguacgagaccuucaaggucaucggcggguggucgaccccgaacuccaagagccagaucaaccgccaggugaucguggacuccgacaaccggucgggcuacuccgggaucuucucggucgagggcaagagcugcaucaaccgcugcuucuacguggagcucauccggggccgcaagcaggagacccgggugugguggaccuccaacucgaucgucguguucugcgggaccuccggcacguacgggaccggcagcuggcccgacggggccaacaucaacuucaugcccaucuga

SEQ ID NO: 18117 - RNA, 1410 nt, Artificial Sequence; identical to SEQ ID NO: 16505
  derived and/or modified CDS sequence (AUadapt) from InfluenzaA__ABN51135__NA

SEQ ID NO: 18118 - RNA, 1413 nt, Artificial Sequence; identical to SEQ ID NO: 16798
  derived and/or modified CDS sequence (AUadapt) from InfluenzaA__ABN51146__NA

SEQ ID NO: 18119 - RNA, 1410 nt, Artificial Sequence
  derived and/or modified CDS sequence (AUadapt) from InfluenzaA__ABN51157__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggagaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 18120 - RNA, 1410 nt, Artificial Sequence; identical to SEQ ID NO: 18108
  derived and/or modified CDS sequence (AUadapt) from InfluenzaA__ABN59393__NA

SEQ ID NO: 18121 - RNA, 1365 nt, Artificial Sequence; identical to SEQ ID NO: 16322
  derived and/or modified CDS sequence (AUadapt) from InfluenzaA__ABN59415__NA

SEQ ID NO: 18122 - RNA, 1413 nt, Artificial Sequence; identical to SEQ ID NO: 17353
  derived and/or modified CDS sequence (AUadapt) from InfluenzaA__ABN59426__NA

SEQ ID NO: 18123 - RNA, 1410 nt, Artificial Sequence; identical to SEQ ID NO: 16655
  derived and/or modified CDS sequence (AUadapt) from InfluenzaA__ABO32659__NA

SEQ ID NO: 18124 - RNA, 1410 nt, Artificial Sequence
  derived and/or modified CDS sequence (AUadapt) from InfluenzaA__ABO32670__NA
augaaccccaaccagaagaucaucaccaucggcucggugucccugaccaucucgacgaucugcuucuucaugcagaucgccauccucgucaccaccgugacccugcacuucaagcaguacgagugcaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggagcaagccgcagugcaacaucaccggguucgcgcccuucuccaaggacaacucgauccgccuguccgccggcggggacaucugggugacccgggagcccuacgugagcugcgaccccgacaagugcuaccaguucgcccucggccaggggaccacgcugaacaacggccacuccaacgacaccguccacgaccgcaccccguaccggacccugcucaugaacgagcugggcgugcccuuccacauggggacgaagcaggucugcaucgccuggucguccagcuccugccacgacggcaaggccuggcugcacgugugcgugaccggggacgacgagaacgcgaccgccucguucaucuacaacggccgccucguggacuccaucgggucgugguccaagaagauccugcggacccaggagagcgagugcgucugcaucaacggcacgugcaccguggugaugaccgacggcuccgccucggggaaggccgacaccaagauccuguucaucgaggagggcaagaucguccacacgagcacccucuccgggucggcgcagcacguggaggagugcuccugcuacccccgcuaccccggcgugcggugcgucugccgcgacaacuggaagggcagcaaccggccgaucguggacaucaacaucaaggacuacuccaucgugucguccuacgucugcagcgggcuggugggcgacacgccccgcaagaacgacuccucguccucgucccacugccuggaccccaacaacgaggagggcgggcacggggugaagggcugggccuucgacgacggcaacgacgucuggauggggcggaccaucagcgagaagcuccgcuccggcuacgagaccuucaaggugaucgagggguggucgaagcccaacuccaagcugcagaucaaccggcaggucaucguggaccgcggcaaccggagcggguacuccggcaucuucucgguggagggcaagagcugcaucaaccgcugcuucuacgucgagcugauccgggggcgcaagcaggagaccgaggugcucuggaccuccaacucgaucguggucuucugcggcaccuccgggacguacggcaccgggagcuggccggacggcgccgacaucaaccugaugcccaucuga

SEQ ID NO: 18125 - RNA, 1413 nt, Artificial Sequence; identical to SEQ ID NO: 17976
  derived and/or modified CDS sequence (AUadapt) from InfluenzaA__ABO32681__NA

SEQ ID NO: 18126 - RNA, 1410 nt, Artificial Sequence
  derived and/or modified CDS sequence (AUadapt) from InfluenzaA__ABO32695__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugcucggaccccaacaacgaggagggcgggcacggggucaagggcugggccuucgacgacgggaacgacguguggaugggccggaccaucuccgagaagcuccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 18127 - RNA, 1410 nt, Artificial Sequence; identical to SEQ ID NO: 17132
  derived and/or modified CDS sequence (AUadapt) from InfluenzaA__ABO32754__NA

SEQ ID NO: 18128 - RNA, 1410 nt, Artificial Sequence; identical to SEQ ID NO: 17132
  derived and/or modified CDS sequence (AUadapt) from InfluenzaA__ABO32765__NA

SEQ ID NO: 18129 - RNA, 1410 nt, Artificial Sequence; identical to SEQ ID NO: 18004
  derived and/or modified CDS sequence (AUadapt) from InfluenzaA__ABO32778__NA

SEQ ID NO: 18130 - RNA, 1410 nt, Artificial Sequence
  derived and/or modified CDS sequence (AUadapt) from InfluenzaA__ABO32793__NA
augaaccccaaccagaagaucaucaccaucggcucggugucccugaccaucagcacgaucugcuucuucaugcagaucgucauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcccccuucuccaaggacaacagcauccgccuguccgcgggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgccaccgcgucguucaucuacaacgggcgccuggucgacuccaucgugagcugguccaaggagauccugcggacccaggagagcgagugcgugugcaucaacggcacgugcaccgucgugaugaccgacggguccgccucgggcaagaccgacacgaagauccucuucaucgaggagggcaagaucgugcacaccagcacccuguccgggucggcccagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcucgggccuggucggcgacacgccccgcaagaacgacuccagcuccucgucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcacguccgggaccuacggcaccgggagcuggccggacggcgcggacaucaaccugaugcccaucuga

SEQ ID NO: 18131 - RNA, 1410 nt, Artificial Sequence; identical to SEQ ID NO: 16729
  derived and/or modified CDS sequence (AUadapt) from InfluenzaA__ABO32806__NA

SEQ ID NO: 18132 - RNA, 1410 nt, Artificial Sequence; identical to SEQ ID NO: 17116
  derived and/or modified CDS sequence (AUadapt) from InfluenzaA__ABO32819__NA

SEQ ID NO: 18133 - RNA, 1410 nt, Artificial Sequence; identical to SEQ ID NO: 16748
  derived and/or modified CDS sequence (AUadapt) from InfluenzaA__ABO32830__NA

SEQ ID NO: 18134 - RNA, 1410 nt, Artificial Sequence; identical to SEQ ID NO: 17114
  derived and/or modified CDS sequence (AUadapt) from InfluenzaA__ABO32841__NA

SEQ ID NO: 18135 - RNA, 1410 nt, Artificial Sequence; identical to SEQ ID NO: 17114
  derived and/or modified CDS sequence (AUadapt) from InfluenzaA__ABO32852__NA

SEQ ID NO: 18136 - RNA, 1410 nt, Artificial Sequence; identical to SEQ ID NO: 17114
  derived and/or modified CDS sequence (AUadapt) from InfluenzaA__ABO32863__NA

SEQ ID NO: 18137 - RNA, 1410 nt, Artificial Sequence; identical to SEQ ID NO: 18108
  derived and/or modified CDS sequence (AUadapt) from InfluenzaA__ABO32874__NA

SEQ ID NO: 18138 - RNA, 1410 nt, Artificial Sequence; identical to SEQ ID NO: 18108
  derived and/or modified CDS sequence (AUadapt) from InfluenzaA__ABO32885__NA

SEQ ID NO: 18139 - RNA, 1410 nt, Artificial Sequence; identical to SEQ ID NO: 18109
  derived and/or modified CDS sequence (AUadapt) from InfluenzaA__ABO32896__NA

SEQ ID NO: 18140 - RNA, 1410 nt, Artificial Sequence; identical to SEQ ID NO: 18109
  derived and/or modified CDS sequence (AUadapt) from InfluenzaA__ABO32907__NA

SEQ ID NO: 18141 - RNA, 1410 nt, Artificial Sequence
  derived and/or modified CDS sequence (AUadapt) from InfluenzaA__ABO32918__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaacuccaacucgaagcugcagaccaaccgccaggugaucguggaccggggcaaccgguccggguacagcggcaucuucucggucgaggggaaguccugcaucaaccgcugcuucuacguggagcucauccggggccgcaaggaggagaccgaggugcuguggacgagcaacuccaucgucguguucugcggcaccagcgggaccuacggcaccggguccuggcccgacggcgccgacaucaaccugaugccgaucuga

SEQ ID NO: 18142 - RNA, 1410 nt, Artificial Sequence; identical to SEQ ID NO: 18141
  derived and/or modified CDS sequence (AUadapt) from InfluenzaA__ABO32929__NA

SEQ ID NO: 18143 - RNA, 1410 nt, Artificial Sequence; identical to SEQ ID NO: 18141
  derived and/or modified CDS sequence (AUadapt) from InfluenzaA__ABO32940__NA

SEQ ID NO: 18144 - RNA, 1413 nt, Artificial Sequence
  derived and/or modified CDS sequence (AUadapt) from InfluenzaA__ABO32951__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 18145 - RNA, 1413 nt, Artificial Sequence
  derived and/or modified CDS sequence (AUadapt) from InfluenzaA__ABO32962__NA
augaaccccaaccagaagaucaucaccaucggcucgaucuccaucgccaucgggaucaucagccugaugcuccagaucggcaacaucaucuccaucugggccucgcacuccauccagaccgggagcaagaaccacacgggcgugugcaaccagcgcaucaucaccuacgagaacuccaccugggucaaccacaccuacgugaacaucaacaacacgaacguggucgcggggaaggacaagaccucggugacccuggccggcaacuccagccugugcuccaucucgggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccucgccguacaacagcaaguucgaguccguggccuggagcgccaacgccugccacgacggcaugggcuggcucaccaucgggaucuccggccccgacaacggggcggucgccgugcugaaguacaacggcaucaucacggagaccaucaagucguggaagaagcagauccugcgcacccaggaguccgagugcgugugcgucaacggcagcugcuucaccaucaugacggacgggcccuccaacggcgccgccucguacaagaucuucaagaucaagaaggggaaggugaccaaguccaucgagcucaacgcccccaacuuccacuacgaggagugcagcugcuacccggacaccggcaccgugaugugcgucugccgggacaacuggcacggguccaaccgccccugggugucguucaaccagaaccuggacuaccagaucggcuacaucugcuccggcguguucggggacaacccccggcccaaggacggcgaggggagcugcaacccggucacgguggacggcgcgaacggggugaagggcuucuccuacaaguacggcaacggggucuggaucggccgcaccaagucgaaccggcugcgcaagggguucgagaugaucugggaccccaacggcuggaccgacaccgacuccgacuucagcgugcggcaggacguggucgccaucacggacugguccggguacucgggcagcuucgugcagcaccccgagcucaccggccuggacugcauccgccccugcuucugggucgagcuggugcgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 18146 - RNA, 1413 nt, Artificial Sequence; identical to SEQ ID NO: 16788
  derived and/or modified CDS sequence (AUadapt) from InfluenzaA__ABO32973__NA

SEQ ID NO: 18147 - RNA, 1413 nt, Artificial Sequence; identical to SEQ ID NO: 17353
  derived and/or modified CDS sequence (AUadapt) from InfluenzaA__ABO32984__NA

SEQ ID NO: 18148 - RNA, 1413 nt, Artificial Sequence; identical to SEQ ID NO: 17353
  derived and/or modified CDS sequence (AUadapt) from InfluenzaA__ABO32995__NA

SEQ ID NO: 18149 - RNA, 1413 nt, Artificial Sequence
  derived and/or modified CDS sequence (AUadapt) from InfluenzaA__ABO33009__NA
augaaccccaaccagaagaucaucaccaucggcucgaucugcauggccaucgggaugaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacagcauccgcaucggguccaagggcgacguguucgugauccgggagcccuucaucucgugcucccaccucgagugccgcacguucuuccugacccagggggcccugcucaacgacaagcacagcaacggcaccgucaaggaccggucccccuaccgcgcccugaugucgugccccaucggggaggccccgucccccuacaacagccgguucgagagcguggcgugguccgccucggccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcucgugcuucaccaucaugacggacgggcccuccgacggcccggccagcuaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggucgaaccgccccuggguguccuucaaccagaaccucgacuaccagaucggcuacaucugcagcggcgucuucggggacaacccgcggcccaaggacggcaagggguccugcgaccccgugaacguggacggcgccgacggggucaagggcuucucguaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggucgggguacuccggcagcuucgugcagcacccggagcugacgggccucgacugcaugcggcccugcuucugggucgagcugauccgcgggcggccccgcgagaagaccaccaucuggaccuccggcucguccaucagcuucugcggggugaacuccgacacggucaacuggagcuggcccgacggcgcggagcugccguucaccaucgacaaguga

SEQ ID NO: 18150 - RNA, 1410 nt, Artificial Sequence; identical to SEQ ID NO: 17920
  derived and/or modified CDS sequence (AUadapt) from InfluenzaA__ABO33039__NA

SEQ ID NO: 18151 - RNA, 1410 nt, Artificial Sequence
  derived and/or modified CDS sequence (AUadapt) from InfluenzaA__ABO33050__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcucggccuccgggaaggcggacaccaagauccuguucaucgaggagggcaagaucguccacacgagcccccugucgggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccucgcacugccuggaccccaacaacgaggagggcgggcacggggucaagggcugggccuucgacgacggcaacgacguguggauggggcggaccaucuccgagaagcugcgcagcggcuacgagaccuucaaggucaucgaggggugguccaagccgaacucgaagcuccagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcuguggaccucgaacuccaucgucguguucugcggcaccagcgggaccuacggcacgggguccuggcccgacggcgccgacaucaaccucaugcccaucuga

SEQ ID NO: 18152 - RNA, 1410 nt, Artificial Sequence; identical to SEQ ID NO: 17132
  derived and/or modified CDS sequence (AUadapt) from InfluenzaA__ABO33061__NA

SEQ ID NO: 18153 - RNA, 1410 nt, Artificial Sequence
  derived and/or modified CDS sequence (AUadapt) from InfluenzaA__ABO33072__NA
augaaccccaaccagaagaucaucaccaucggcucggugucccugaccaucgccacgaucugcuuccucaugcagaucgccauccuggucaccaccgugacccugcacuucaagcaguacgagugcgggucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggcuucgcccccuucagcaaggacaacuccauccgccugucggccgggggcgacaucugggugacccgggagcccuacgucuccugcgaccccgggaagugcuaccaguucgcccucggccagggcaccacccuggacaacaagcacagcaacgacacgauccacgaccgcaccccgcaccggacccugcucaugaacgagcugggggugcccuuccaccugggcacccgccaggugugcaucgccugguccucguccagcugccacgacgggaaggcguggcuccacgucugcgugacgggcuacgacaagaacgccaccgccuccuucaucuacgacgggcggcugguggacucgaucggcuccuggucgaagaacauccugcgcacccaggaguccgagugcgucugcaucaacgggaccugcacgguggugaugaccgacggcagcgccuccgagcgggcggacaccaagauccucuucaucgaggagggcaagaucguccacaucucgccccugagcggguccgcccagcacguggaggagugcucgugcuacccccgcuacccgggcgugcggugcgucugccgcgacaacuggaagggcuccaaccggcccgugguggacaucaacgucaaggacuacagcaucguguccucguacgugugcuccgggcuggucggcgacacgccccgcaagaacgaccggagcuccucguccuacugccgcaaccccaacaacgagaaggggaaccacggcgugaaggggugggccuucgacgacggcaacgacgucuggaugggccggaccaucucggaggagucccgcagcggguacgagaccuucaaggugaucggcgggugguccaccccgaacucgaagcuccagaucaaccgccaggugaucgucgacuccgacaaccggagcggcuacuccgggaucuucucgguggagggcaagagcugcaucaaccggugcuucuacguggagcugauccgcggccgcgagcaggagacccgggucugguggacguccaacucgaucgugguguucugcgggaccuccggcaccuacgggaccggcagcuggcccgacggggccgacaucaaccugaugcccaucuga

SEQ ID NO: 18154 - RNA, 1413 nt, Artificial Sequence; identical to SEQ ID NO: 17461
  derived and/or modified CDS sequence (AUadapt) from InfluenzaA__ABO37991__NA

SEQ ID NO: 18155 - RNA, 1413 nt, Artificial Sequence
  derived and/or modified CDS sequence (AUadapt) from InfluenzaA__ABO38013__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggucgcccuaccgcgcccugauguccugcccccugggggaggcgccgagccccuacaacucccgguucgagucggucgccuggagcgccuccgccugccacgacggccucggcuggcugaccaucgggaucucgggccccgacaacggggcgguggccgugcugaaguacaacggcaucaucacggagaccaucaaguccuggaagaagcgcauccuccggacccaggagagcgagugcgucugcaugaacggcuccugcuucaccaucaugacggacgggcccucgaacggcgccgccuccuaccgcaucuucaagaucgagaaggggcgggugaccaagagcaucgagcuggacgccccgaacuaccacuacgaggagugcuccugcuaccccgacaccggcaccgugaugugcgucugccgcgacaacuggcacgggucgaaccggcccuggguguccuucaaccagaaccuggacuaccagaucggcuacaucugcucgggcguguucggggacaacccccgcccgaaggacggcgagggguccugcaaccccgucacgguggacggcgcggacggggugaagggcuucagcuaccgguacggcaacggggucuggaucggccgcaccaaguccaaccggcuccgcaagggguacgagaugaucugggaccccaacggcuggaccgacaccgacucggacuucuccaugaagcaggacaucguggccaugacggacuggagcggguacuccggcucguucgugcagcaccccgagcugaccggccuggacugcaugcggccgugcuucugggucgagcucgugcgcgggcugccccgggagaacaccaccaucuggacgagcggcuccucgaucuccuucugcggggugaacagcgacaccgccaacugguccuggcccgacggcgccgagcugcccuucaccaucgacaaguga

SEQ ID NO: 18156 - RNA, 1413 nt, Artificial Sequence
  derived and/or modified CDS sequence (AUadapt) from InfluenzaA__ABO38024__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacaacaccugggugaaccacaccuacgucaacaucaacaacacgaacaucguggcggggaaggacaagaccuccgugacccuggccggcaacucgucccugugcagcaucuccggcugggccaucuacaccaaggacaacucgauccggaucggguccaagggcgacgucuucgugauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccuccccguacaacucgaaguucgagagcgucgccugguccgccagcgccugccacgacggcaugggcuggcucaccaucgggaucuccggccccgacaacggggcgguggccgugcugaaguacaacggcaucaucacggagaccaucaagucguggaagaagcgcauccugcggacccaggaguccgagugcgucugcgugaacggcagcugcuucaccaucaugacggacgggcccuccaacggcgccgccucguacaagaucuucaagaucgagaaggggaaggugaccaaguccaucgagcucaacgcccccaacuuccacuacgaggagugcagcugcuacccggacaccggcaccgucaugugcgugugccgcgacaacuggcacggguccaaccggcccugggugucguucaaccagaaccuggacuaccagaucggcuacaucugcuccggcgucuucggggacaacccccgccccaaggacggcgaggggagcugcaacccggugacgguggacggcgcggacggggucaagggcuucuccuacaaguacggcaacgggguguggaucggccggaccaagucgaaccgccugcggaagggguucgagauggugugggaccccaacggcuggaccgacaccgacuccgacuucagcgucaagcaggacgugguggccaucacggacugguccggguacucgggcagcuucguccagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 18157 - RNA, 1413 nt, Artificial Sequence
  derived and/or modified CDS sequence (AUadapt) from InfluenzaA__ABO38035__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacggggaccugcaaccagcgcaucaucaccuacgagaacuccaccugggugaaccacacguacgucaacaucaacaacaccaacgugguggcgggcaaggacaagaccucggucacccuggccggcaacuccagccugugcuccaucucgggcugggccaucuacacgaaggacaacuccauccggaucgggagcaagggcgacguguucgugauccgcgagccguucaucuccugcucgcaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccgagaccaucaaguccuggaagaagcgcauccugcggacccaggagagcgagugcgugugcgugaacggcuccugcuucacgaucaugaccgacgggcccucgaacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccagaucggcuacaucugcagcggcguguucggggacaacccccgccccaaggacggcgagggguccugcaacccggugaccgucgacggcgcggacggggugaagggcuucucguacaaguacggcaacgggguguggaucggccggaccaaguccaaccgccugcggaagggguucgaggucaucugggaccccaacggcuggaccgacacggacagcgacuucuccgugaagcaggacguggucgccaucaccgacuggucgggguacagcggcuccuucgugcagcaccccgagcucaccggccuggacugcauccgccccugcuucugggucgagcuggugcgggggaugccgcgcgagaacaccacgaucuggaccucgggcuccagcaucuccuucugcggggugaacagcgacaccgccaacugguccuggcccgacggcgccgagcuccccuucaccaucgacaaguga

SEQ ID NO: 18158 - RNA, 1413 nt, Artificial Sequence; identical to SEQ ID NO: 16798
  derived and/or modified CDS sequence (AUadapt) from InfluenzaA__ABO38046__NA

SEQ ID NO: 18159 - RNA, 1413 nt, Artificial Sequence; identical to SEQ ID NO: 17353
  derived and/or modified CDS sequence (AUadapt) from InfluenzaA__ABO38068__NA

SEQ ID NO: 18160 - RNA, 1410 nt, Artificial Sequence; identical to SEQ ID NO: 16729
  derived and/or modified CDS sequence (AUadapt) from InfluenzaA__ABO38079__NA

SEQ ID NO: 18161 - RNA, 1410 nt, Artificial Sequence
  derived and/or modified CDS sequence (AUadapt) from InfluenzaA__ABO38090__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgagcgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 18162 - RNA, 1410 nt, Artificial Sequence
  derived and/or modified CDS sequence (AUadapt) from InfluenzaA__ABO38101__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacgcaggagagcgagugcgugugcaucaacgggaccugcaccgucgugaugaccgacggcuccgcgucgggccgggccgacacgcgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcagcgggcuggucggcgacacgccccggaacgacgacuccucguccaacucgaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacucgaagucccaggugaaccgccaggucaucguggacaacaacaacuggucgggcuacuccgggaucuucagcguggagggcaagucgugcaucaaccggugcuucuacgucgagcugauccgcggccgcccccaggagacccgggugugguggaccuccaacucgaucguggucuucugcgggaccuccggcacguacgggaccggcagcuggcccgacggggccaacaucaacuucaugccgaucuga

SEQ ID NO: 18163 - RNA, 1410 nt, Artificial Sequence
  derived and/or modified CDS sequence (AUadapt) from InfluenzaA__ABO38233__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgaagaacauccugcgcacccaggaguccgagugcgucugcaucaacgggaccugcacgguggugaugaccgacggcagcgccuccgagcgggcggacaccaagauccucuucaucgaggaggggaagaucguccacaucucgccccugagcggcuccgcccagcacguggaggagugcucgugcuacccccgcuacccgggggugcggugcgucugccgcgacaacuggaagggcuccaaccggcccgugguggacaucaacgucaaggacuacucgaucgccuccagcuacgugugcuccggccuggugggggacacgccccgcaagaacgaccgguacucguccagcuacugccgcaaccccaacaacgagaagggcaaccacggggucaagggcugggccuucgacgacgggaacgacguguggaugggccggaccaucuccgacgagucgcgcuccggcuacgagaccuucaaggucaucgggggcuggucgaccccgaacuccaagcuccagaucaaccgccaggugaucguggacagcgacaaccgguccggguacucgggcaucuucuccgucgagggcaagagcugcaucaaccggugcuucuacguggagcugauccgcggccgcgagcaggagacccgggugugguggacgucgaacuccaucgucguguucugcggcaccagcgggaccuacggcaccggguccuggcccgacggcgccgacaucaaccugaugcccaucuga

SEQ ID NO: 18164 - RNA, 1410 nt, Artificial Sequence; identical to SEQ ID NO: 17513
  derived and/or modified CDS sequence (AUadapt) from InfluenzaA__ABO38244__NA

SEQ ID NO: 18165 - RNA, 1410 nt, Artificial Sequence; identical to SEQ ID NO: 16729
  derived and/or modified CDS sequence (AUadapt) from InfluenzaA__ABO38255__NA

SEQ ID NO: 18166 - RNA, 1410 nt, Artificial Sequence; identical to SEQ ID NO: 17114
  derived and/or modified CDS sequence (AUadapt) from InfluenzaA__ABO38277__NA

SEQ ID NO: 18167 - RNA, 1410 nt, Artificial Sequence; identical to SEQ ID NO: 18141
  derived and/or modified CDS sequence (AUadapt) from InfluenzaA__ABO38288__NA

SEQ ID NO: 18168 - RNA, 1410 nt, Artificial Sequence
  derived and/or modified CDS sequence (AUadapt) from InfluenzaA__ABO38299__NA
augaaccccaaccagaagaucaucaccaucggcucggugucccugaccaucgccacggucugcuucaucaugcagaucgccauccucgcgaccaccgugacccugcacuucaagcagcacgagugcgacucgccggccuccaaccaggugaugcccugcgagcccaucaucaucgagcgcaacaucacggagaucgucuaccugaacaacaccaccaucgagaaggagaucugccccgaggccguggaguaccggaacuggucgaagccgcagugccagaucaccggguucgcccccuucuccaaggacaacucgauccgccucuccgccggcggggacaucugggugacgcgggagcccuacgucagcugcgaccccggcaagugcuaccaguucgcgcuggggcagggcaccacccuggacaacaagcacuccaacggcaccauccacgaccgcaucccgcaccggacgcuccugaugaacgagcugggggugcccuuccaccucggcaccaagcaggucugcguggccuggucguccucguccugccacgacgggaaggccuggcugcacgugugcgugaccggcgacgaccgcaacgccaccgcgucguucaucuacgacgggcggcuggucgacuccaucggcagcuggucccagaacauccuccgcacgcaggagucggagugcgugugcaucaacgggaccugcaccguggucaugaccgacggcuccgccucgggccgggccgacacgcgcauccuguucaucaaggaggggaagaucgugcacaucucgccccuguccggcagcgcccagcacguggaggagugcuccugcuacccccgguacccggacguccgcugcacgugccgggacaacuggaagggcucgaaccgccccgugaucgacaucaacauggaggacuacuccaucgacucguccuacgugugcucggggcucgucggcgacacgccccggaacgacgacuccagcuccaacucgaacugccgcgaccccaacaacgagcgggggaacccgggcgugaaggggugggccuucgacaacggcgacgacguguggaugggccgcaccaucaacaaggacucccggucgggguacgagaccuucaaggucaucggcgggugguccacccccaacucgaagucccaggugaaccgccaggucaucguggacaacaacaacuggagcggcuacuccgggaucuucucgguggagggcaagucgugcaucaaccggugcuucuacgucgagcugauccgcggccgcccccaggagacccgggugugguggaccuccaacucgaucguggucuucugcgggaccuccggcaccuacgggaccggcagcuggcccgacggggcgaacaucaacuucaugccgaucuga

SEQ ID NO: 18169 - RNA, 1410 nt, Artificial Sequence
  derived and/or modified CDS sequence (AUadapt) from InfluenzaA__ABO38310__NA
augaaccccaaccagaagaucaucaccaucggcucggugucccugaccaucgccacggucugcuuccucaugcagaucgccauccuggcgaccaccgugacccugcacuucaagcagcacgagugcgacucgccgacguccaaccaggugaugcccugcgagcccaucaucaucgagcgcaacaucaccgagaucgucuaccucaacaacaccaccaucgagaaggagaucugccccgaggugguggaguaccggaacuggucgaagccgcagugccagaucacgggguucgcccccuucuccaaggacaacagcauccgccuguccgccggcggggacaucugggucacccgggagcccuacgugucgugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggccuggucguccagcuccugccacgacgggaaggcguggcugcacgugugcgucaccggcgacgaccgcaacgccacggccucguucaucuacgacgggcggcucguggacuccaucggcucguggucccagaacauccugcgcacccaggagagcgagugcgugugcaucaacgggaccugcaccgucgugaugacggacggcuccgccucgggccgggcggacacccgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcagcgggcuggucggcgacacgccccggaacggggacuccucguccaacucgaacugccgcgaccccaacaacgagcggggcaacccgggggugaagggcugggccuucgacaacggcgacgacguguggauggggcgcaccaucaacaaggagucccggagcggcuacgagaccuucaaggucaucgggggcugguccacccccaacucgaagucccaggugaaccgccaggucaucguggacaacaacaacuggucgggguacuccggcaucuucagcguggagggcaagucgugcaucaaccggugcuucuacgucgagcugauccgcgggcgcccccaggagacccgggugugguggaccuccaacucgaucguggucuucugcggcacguccgggaccuacggcaccgggagcuggcccgacggcgccaacaucaacuucaugccgaucuga

SEQ ID NO: 18170 - RNA, 1413 nt, Artificial Sequence; identical to SEQ ID NO: 17332
  derived and/or modified CDS sequence (AUadapt) from InfluenzaA__ABO38332__NA

SEQ ID NO: 18171 - RNA, 1413 nt, Artificial Sequence
  derived and/or modified CDS sequence (AUadapt) from InfluenzaA__ABO38343__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgcccuaccgcgcccugauguccugccccaucggggaggccccgagccccuacaacucccgguucgagucgguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagucggagugcgugugcgucaacggcuccugcuucacgaucaugaccgacgggcccagcaacggcccggcguccuaccggaucuucaagaucgagaaggggaagaucaccaagucgaucgagcuggacgcccccaacucccacuacgaggagugcagcugcuaccccgacaccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagucgaacuccagccggaagggguucgagaugaucugggaccccaacggcuggaccgacacggacuccaacuuccuggucaagcaggacgugguggccaugaccgacuggucgggguacagcggcuccuucguccagcacccggagcugaccggccucgacugcaugcgccccugcuucuggguggagcugguccgggggcgcccccgggagggcaccacgguguggaccucgggguccagcaucuccuucugcggcgugaacagcgacaccgccaacugguccuggcccgacggcgcggagcugccguucaccaucgacaaguga

SEQ ID NO: 18172 - RNA, 1410 nt, Artificial Sequence
  derived and/or modified CDS sequence (AUadapt) from InfluenzaA__ABO38354__NA
augaaccccaaccagaagaucaucaccaucggcucgaucugcaugguggucgggaucaucucccugauccuccagaucggcaacaucaucagcaucuggaucucccacagcauccagaccgggucccagaaccacacgggcaucugcaaccagaacaucaucaccuacaagaacucgaccugggugaaccagaccuacgugaacaucuccaacacgaacgucguggccgggcaggacaccaccagcgugauccugaccggcaacuccagccugugcccgauccgcggcugggccaucuacuccaaggacaacucgauccggaucggguccaagggcgacgucuucgugauccgcgagcccuucaucagcugcucccaccucgagugccggacguucuuccugacccagggggcgcugcucaacgaccgccacagcaacggcaccgugaaggaccggucccccuaccgcgcccugaugagcugccccgucggggaggccccgucccccuacaacucgcgguucgagagcguggccugguccgccagcgcgugccacgacggcaugggcuggcugaccaucgggaucuccggccccgacaacggggccguggccguccucaaguacaacggcaucaucacggagaccaucaagucguggcgcaagaagauccugcggacccaggaguccgagugcgccugcgugaacggcagcugcuucaccaucaugacggacgggcccuccaacggccuggcgagcuacaagaucuucaagaucgagaaggggaaggugaccaaguccaucgagcucaacgccccgaacucgcacuacgaggagugcuccugcuaccccgacaccggcaaggucaugugcgugugccgcgacaacuggcacgggagcaaccggcccuggguguccuucgaccagaaccuggacuaccagaucggcuacaucugcagcggcgucuucggggacaacccccgcccgaaggacggcaccggguccugcggccccguguacguggacggggccaacggcgucaagggcuucagcuaccgguacgggaacggcguguggaucgggcgcacgaaguccaacucgucccggcacggcuucgagaugaucugggaccccaacggguggaccgagaccgacagcaaguucagcgugcgccaggacgucguggccaugaccgacugguccggcuacucgggcuccuucguccagcaccccgagcugacggggcucgacugcaugcggccgugcuucuggguggagcugauccgcggccggcccaaggagaacaccaucuggaccagcggguccagcaucuccuucugcggcgugaacagcgacaccgucgacugguccuggcccgacggcgccgagcugcccuucacgaucgacaaguga

SEQ ID NO: 18173 - RNA, 1413 nt, Artificial Sequence
  derived and/or modified CDS sequence (AUadapt) from InfluenzaA__ABO38365__NA
augaaccccaaccagaagaucaucaccaucggcucgaucugcauggccaucgggaucaucucccugauccuccagaugggcaacaucaucagcaucugggugucccacucgauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacucgucccugugcccgauccggggcugggccaucuacagcaaggacaacuccauccgcaucgggucgaagggcgacguguucgucauccgggagcccuucaucuccugcagccaccucgagugccgcacguucuuccugacccagggggcccugcucaacgacaagcacuccaacggcaccgugaaggaccggucgcccuaccgcgcccugauguccugccccaucggggaggccccgagccccuacaacucccgguucgagucgguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagucggagugcgugugcgucaacggcuccugcuucaccaucaugacggacgggcccagcaacggcccggccuccuaccggaucuucaagaucgagaaggggaagaucaccaagucgaucgagcuggacgcccccaacucccacuacgaggagugcagcugcuaccccgacaccggcaccgugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugacggucgacggcgccgacggggugaagggcuucuccuaccgguacggcaacgggguguggaucggccgcaccaagucgaacuccagccggaagggguucgagaugaucugggaccccaacggcuggaccgacaccgacuccaacuuccuggucaagcaggacgugguggccaugacggacuggucgggguacagcggcuccuucguccagcacccggagcugaccggccucgacugcaugcgccccugcuucuggguggagcugauccgggggcgcccccgggagaagaccaccaucuggacgucgggcuccagcaucuccuucugcggggucaacagcgacaccgcgaacugguccuggcccgacggcgccgagcugccguucaccaucgacaaguga

SEQ ID NO: 18174 - RNA, 1410 nt, Artificial Sequence
  derived and/or modified CDS sequence (AUadapt) from InfluenzaA__ABO38376__NA
augaaccccaaccagaagaucaucaccaucggcucgaucugcaugguggucgggaucaucucccugauccuccagaucggcaacaucaucagcaucuggaucucccacucgauccagaccgggucccagaaccacacggggaccugcaaccagagcaucaucaccuacaagaacuccaccugggugaaccagacguacgugaacaucagcaacaccaacgucguggccggcaaggacaccaccuccgugauccuggccggcaacucgucccugugcccgauccgcggcugggcgaucuacagcaaggacaacgggguccggaucggcuccaagggggacguguucgugauccgcgagcccuucaucagcugcucccaccucgagugccggacguucuuccugacccagggcgcccugcucaacgacaagcacucgaacgggaccgucaaggaccgcucccccuaccgggcccugaugagcugccccgugggcgaggccccgucccccuacaacagccgcuucgagucgguggccugguccgcgagcgccugccacgacggcaugggguggcugaccaucggcaucuccgggcccgacgacggcgccgucgccgugcucaaguacaacggcaucaucacggagaccaucaagagcuggcggaaggagauccugcgcacccaggaguccgagugcgcgugcgugaacgggucgugcuucaccaucaugacggacggccccuccgggggcccggccagcuacaagaucuucaagaucgagaaggggaaggucaccaaguccaucgagcuggacgcccccaacagccacuacgaggagugcuccugcuaccccgacaccggcaaggugaugugcgugugccgggacaacuggcacggcucgaaccgccccugggucuccuucgaccagaaccucgacuaccagaugggguacaucugcagcggcguguucggggacaacccgcggcccaaggacggcaaggggaacugcggccccguguacgucgacggcgccaacggggugaagggcuucuccuaccgcuacgggaacggcguguggaucgggcggaccaagagcaacuccucgcgccagggcuucgagaugaucugggaccccaacggcuggacggagaccgacuccaacuucuucgucaagcaggacguggucgccgugaccgacuggagcggguacagcggcuccuucgugcagcacccggagcugaccgggcuggacugcaugcggcccugcuucugggucgagcucauccgcggccggcccaaggagaagacgaucuggaccucgggcuccagcaucuccuucugcggggugaacagcgacaccguggacugguccuggcccgacggcgcggagcugccguucaccaucgacaaguga

SEQ ID NO: 18175 - RNA, 1410 nt, Artificial Sequence
  derived and/or modified CDS sequence (AUadapt) from InfluenzaA__ABO38387__NA
augaaccccaaccagaagaucaucaccaucggcucgaucugcaugguggucgggaucaucucccugauccuccagaucggcaacaucaucagcaucuggaucucccacagcauccagaccgggucccagaaccacacgggcaucugcaaccagucgaucaucaccuacaagaacuccaccugggugaaccagaccuacgugaacaucagcaacacgaacgucguggccgggcaggacaccaccuccgugauccugaccggcaacagcucccugugcccgauccgcggcugggccaucuacucgaaggacaacgggauccggaucggcuccaagggggacgucuucgugauccgcgagcccuucaucagcugcucccaccucgagugccggacguucuuccugacccagggcgcgcugcucaacgacaagcacagcaacgggaccgugaaggaccgcucccccuaccgggcccugaugagcugccccgucggcgaggccccgucccccuacaacucgcgcuucgagagcguggccugguccgccagcgcgugccacgacggcaugggguggcugaccaucggcaucuccgggcccgacaacgaggccguggccguccucaaguacaacggcaucaucacggagaccaucaagucguggcggaagaagauccugcgcacccaggaguccgagugcgccugcgugaacggcagcugcuucaccaucaugacggacgggcccuccgacggccuggcgagcuacaagaucuucaagaucgagaaggggaaggugaccaaguccaucgagcucaacgccccgaacucgcacuacgaggagugcuccugcuaccccgacaccggcaaggucaugugcgugugccgggacaacuggcacgggagcaaccgccccuggguguccuucgaccagaaccuggacuaccagaucggcuacaucugcagcggcgucuucggggacaacccccggccgaaggacggcaccggguccugcggccccguguacguggacggggccaacggcgucaagggcuucagcuaccgcuacgggaacggcguguggaucgggcggacgaaguccaccucgucccgccacggcuucgagaugaucugggaccccaacggguggaccgagaccgacagcaaguucagcgugcggcaggacgucguggccaugacggacugguccggcuacucgggcuccuucguccagcaccccgagcugaccgggcucgacugcaugcgcccgugcuucuggguggagcugauccggggccagcccaaggagaagaccaucuggaccagcggguccagcaucuccuucugcggcgugaacagcgacacggucgacugguccuggcccgacggcgccgagcugcccuucaccaucgacaaguga

SEQ ID NO: 18176 - RNA, 1413 nt, Artificial Sequence
  derived and/or modified CDS sequence (AUadapt) from InfluenzaA__ABO38398__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaacuucuuccugacccagggggcccugcucaacgacaagcacucgaacggcacggugaaggaccgcucccccuaccgggcccugaugagcugccccaucggggaggcgccgucccccuacaacucgcgcuucgagagcguggccugguccgccagcgccugccacgacggcaugggcuggcugaccaucgggaucuccggccccgacgacggggcggucgccgugcucaaguacaacggcaucaucaccgagaccaucaagucguggcggaagcgcauccugcggacgcaggaguccgagugcgugugcgucaacggcagcugcuucaccaucaugaccgacgggcccaacaacggcccggccuccuacaagaucuucaagaucgagaaggggaagaucaccaagucgaucgagcuggacgcccccaacucccacuacgaggagugcagcugcuaccccgacgccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugaccgucgacggcgcggacggggugaagggcuucuccuaccgguacggcaacgggguguggaucggccgcaccaagucgaacuccagccggcgcggguucgagaugaucugggaccccaacggcuggaccgacacggacuccaaguuccuggucaagcaggacgugguggccaugaccgacuggucgggguacagcggcuccuucguccagcacccggagcugaccggccucgacugcaugcggcccugcuucuggguggagcugauccgcgggcggccccgcgagaacaccacgaucuggaccucgggcuccagcaucuccuucugcggggucaacggcgacaccgccaacuggagcuggcccgacggcgccgagcugccguucaccaucgacaaguga

SEQ ID NO: 18177 - RNA, 1410 nt, Artificial Sequence; identical to SEQ ID NO: 16655
  derived and/or modified CDS sequence (AUadapt) from InfluenzaA__ABO38420__NA

SEQ ID NO: 18178 - RNA, 1410 nt, Artificial Sequence
  derived and/or modified CDS sequence (AUadapt) from InfluenzaA__ABO38715__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaccugccccaagguggucgaguaccggagcugguccaagccgcagugcaagaucacgggguucgcccccuucucgaaggacaacuccauccgccugucggccggcggggacaucugggugacccgggagcccuacguguccugcgaccccggcaagugcuaccaguucgcccuggggcagggcaccacccucgacaacaagcacagcaacgacacgauccacgaccgcaucccgcaccggacccugcugaugaacgagcucggcguccccuuccaccuggggacccgccaggugugcaucgccugguccucguccucgugccacgacggcaaggcguggcugcacgugugcgucaccggggacgacaagaacgccacggccuccuucaucuacgacggccggcucguggacagcaucggguccuggucgcagaacauccugcgcacccaggaguccgagugcgugugcaucaacgggaccugcaccgucgugaugacggacggcucggccagcggccgggcggacacccgcauccuguucaucgaggagggcaagaucgugcacaucucgccccucuccggguccgcccagcacgucgaggagugcagcugcuacccccgguacccggacgugcgcugcaucugccgggacaacuggaagggcuccaaccgccccaucguggacaucaacauggaggacuacucgaucgacuccucguacgucugcuccggccuggugggggacacgccccggaacgacgaccgcagcuccaacucgaacugccggaaccccaacaacgagcgcggcaaccagggggugaagggcugggccuucgacaacggggacgacgucuggaugggccggaccaucuccaaggaccugcgcucgggcuacgagaccuucaaggugaucgggggcugguccaccccgaacagcaagucccagaucaaccggcaggucaucguggacucggacaaccgcuccggguacucgggcaucuucagcguggaggggaaguccugcaucaaccgcugcuucuacgucgagcucauccggggccgcaagcaggagacccgggugugguggaccucgaacuccaucguggucuucugcggcacgagcgggaccuacggcaccggguccuggcccgacggcgccaacaucaacuucaugcccaucuga

SEQ ID NO: 18179 - RNA, 1410 nt, Artificial Sequence; identical to SEQ ID NO: 18178
  derived and/or modified CDS sequence (AUadapt) from InfluenzaA__ABO38726__NA

SEQ ID NO: 18180 - RNA, 1413 nt, Artificial Sequence
  derived and/or modified CDS sequence (AUadapt) from InfluenzaA__ABO44049__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaucugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 18181 - RNA, 1410 nt, Artificial Sequence
  derived and/or modified CDS sequence (AUadapt) from InfluenzaA__ABO44060__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggucgaagccgcagugcaagaucaccggguucgcccccuucuccaaggacaacagcauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggucguccagcuccugccacgacggcaaggcguggcugcacgugugcgucaccggggacgacaagaacgccaccgccucguucaucuacgacggccggcucguggacuccaucgggucguggucccagaacauccugcgcacgcaggagagcgagugcgugugcaucaacgggaccugcaccgucgugaugaccgacggcuccgccucggggcgggcggacacgaagauccuguucaucgaggagggcaagaucgugcacaucucgccccucuccgggagcgcccagcacgucgaggagugcuccugcuacccccgcuacccggacgugcggugcaucugccgcgacaacuggaagggcucgaaccggcccguggucgacaucaacauggaggacuacuccaucgacucguccuacgugugcagcggccuggugggggacacgccccgcaacgacgaccgguccucgaacuccaacugccgcaaccccaacaacgagcggggcaaccagggggucaagggcugggccuucgacaacggggacgacguguggaugggccgcaccaucucgaaggaccugcgguccggcuacgagaccuucaaggucaucgggggcuggagcaccccgaacuccaagucgcagaucaaccgccaggugaucguggacuccgacaaccggucgggguacuccggcaucuucagcgucgagggcaagucgugcaucaaccgcugcuucuacguggagcucauccgcggccggaagcaggagacccgcgugugguggaccuccaacucgaucgucguguucugcggcaccuccgggacguacggcaccgggagcuggcccgacggcgccaacaucaaccugaugcccaucuga

SEQ ID NO: 18182 - RNA, 1410 nt, Artificial Sequence
  derived and/or modified CDS sequence (AUadapt) from InfluenzaA__ABO44071__NA
augaaccccaaccagaagaucaucaccaucggcuucguguuccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccagcuccugccacgacggcaaggcguggcugcacgugugcaucaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgccagcggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccagcaacuccaacugcaagaaccccaacaacgagcgggggaaccagggcgugaaggggugggccuucgacaacggcgacgacgucuggaugggccgcaccaucucgaaggaccugcgguccggguacgagaccuucaaggugaucggcggguggagcacccccaacuccaagucgcagaucaaccgccaggucaucguggacuccgacaaccggagcggcuacuccgggaucuucucgguggagggcaaguccugcaucaaccgcugcuucuacgucgagcucauccgcggccggaagcaggagacccgcgugugguggaccagcaacucgaucguggucuucugcgggaccuccggcacguacgggaccggcagcuggccggacggggccaacaucaacuucaugcccaucuga

SEQ ID NO: 18183 - RNA, 1410 nt, Artificial Sequence; identical to SEQ ID NO: 16748
  derived and/or modified CDS sequence (AUadapt) from InfluenzaA__ABO44082__NA

SEQ ID NO: 18184 - RNA, 1410 nt, Artificial Sequence
  derived and/or modified CDS sequence (AUadapt) from InfluenzaA__ABO44093__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugagcugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccucguccugccacgacgggaaggccuggcugcacgugugcgucaccggcgacgaccgcaacgccaccgccagcuucaucuacgacgggcggcucguggacuccaucggcucguggucccagaacauccugcgcacgcaggagagcgagugcgugugcaucaacgggaccugcaccgucgugaugaccgacggcuccgcgucgggccgggccgacacgcgcauccuguucaucaaggaggggaagaucgugcacaucagcccccucuccggcucggcccagcacaucgaggagugcuccugcuacccccgguacccggacguccgcugcaucugccgggacaacuggaagggcucgaaccgccccgugcuggacaucuccauggaggacuacagcaucgacuccucguacgugugcuccgggcuggucggcgacacgccccggaacgacgacagcuccucgaacuccaacugccgcgaccccaacaacgagcgggggaacccgggcgugaaggggugggccuucgacaacggcgacgacguguggaugggccgcaccaucagcaaggaccuccgguccggguacgagaccuucaaggucaucggcggguggucgacccccaacuccaagucgcaggugaaccgccaggucaucguggacaacaacaacugguccggcuacagcgggaucuucucgguggagggcaaguccugcaucaaccggugcuucuacgucgagcugauccgcggccgcagccaggagacccgggugugguggaccuccaacucgaucguggucuucugcgggaccuccggcacguacgggaccggcagcuggcccgacggggccaacaucaacuucaugcccaucuga

SEQ ID NO: 18185 - RNA, 1410 nt, Artificial Sequence
  derived and/or modified CDS sequence (AUadapt) from InfluenzaA__ABO44104__NA
augaaccccaaccagaagaucaucaccaucggcucggccucccugaccaucgccacggugugcuuccucaugcagaucgcgauccuggucaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccaaggugguggaguaccggaacuggucgaagccgcagugcaagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgcguggucguccucguccugccacgacggcaaggccuggcugcacgugugcgugaccggggacgacaagaacgccaccgccagcuucaucuacgacggccggcucgucgacuccaucgggucguggucccagaacauccugcgcacgcaggagucggagugcgugugcaucaacgggaccugcaccguggucaugaccgacggcuccgcgagcgggcgggccgacacgcgcauccuguucaucgaggagggcaagaucgugcacaucucgccccucuccgggucggcccagcacguggaggagugcuccugcuacccccgguacccggacguccgcugcaucugccgggacaacuggaagggcucgaaccgccccgugguggacaucaacauggaggacuacuccaucgacagcuccuacgucugcucgggccuggugggggacacgccccggaacgacgaccgcuccucgaacuccaacugccggaaccccaacaacgagaagggcaaccagggggugaagggcugggccuucgacaacggggacgacgucuggaugggccgcaccaucagcaaggaccugcgguccggcuacgagaccuucaaggugaucgggggcuggucgaccccgaacuccaagucgcagaucaaccgccaggucaucguggacuccgacaaccggucgggguacuccggcaucuucagcguggagggcaagucgugcaucaaccgcugcuucuacgucgagcucauccgcggccggaagcaggagacccgcgugugguggaccuccaacucgaucguggucuucugcggcaccuccgggacguacggcaccgggagcuggcccgacggcgccaacaucaaccugaugcccaucuga

SEQ ID NO: 18186 - RNA, 1413 nt, Artificial Sequence
  derived and/or modified CDS sequence (AUadapt) from InfluenzaA__ABO44126__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaccuucuuccugacgcagggggcccugcucaacgacaagcacucgaacggcaccgugaaggaccgcucccccuaccgggcccugaugagcugccccaucggggaggcgccgucccccuacaacucgcgcuucgagagcguggccugguccgccagcgccugccacgacggcaugggcuggcugaccaucgggaucuccggccccgacgacggggcggucgccgugcucaaguacaacggcaucaucaccgagacgaucaagucguggcggaagcgcauccugcggacccaggaguccgagugcgugugcgucaacggcagcugcuucaccaucaugaccgacgggcccaacaacggcccggccuccuacaagaucuucaagaucgagaaggggaagaucaccaagucgaucgagcugaacgcccccaacucccacuacgaggagugcagcugcuaccccgacgccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagucgaacuccagccggcgcggcuucgagaugaucugggaccccaacggguggacggacaccgacuccaaguuccuggucaagcaggacgugguggccaucaccgacuggucgggcuacagcggcuccuucguccagcacccggagcugaccgggcucgacugcaugcggcccugcuucuggguggagcugauccgcggccggccccgcgagaacacgaccaucuggaccucgggguccagcaucuccuucugcggcgucaacggcgacaccgccaacuggagcuggcccgacggggccgagcugccguucacgaucgacaaguga

SEQ ID NO: 18187 - RNA, 1413 nt, Artificial Sequence
  derived and/or modified CDS sequence (AUadapt) from InfluenzaA__ABO52228__NA
augaaccccaaccagaagaucaucaccaucggcucgaucuccaucgccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcaugacccuggccggcaacuccucgcugugcccgauccggggcugggccaucuacaccaaggacaacuccauccgcaucgggagcaagggcgacgucuucgugauccgggagcccuucaucuccugcucgcaccucgagugccgcacguucuuccugacccagggggcccugcucaacgacaagcacuccaacggcaccgugaaggaccggagccccuaccgcgcccugauguccugcccccugggggaggcgccgucgcccuacaacuccaaguucgagagcgucgccuggucggccuccgccugccacgacggccucggcuggcugaccaucgggaucagcggccccgacaacggggcgguggccgugcugaaguacaacggcaucaucacggagaccaucaaguccuggaagaagcggauccuccgcacccaggagucggagugcgucugcaugaacggcuccugcuucaccaucaugacggacgggcccagcaacggcgccgccuccuaccggaucuucaagaucgagaaggggcgcgugaccaagucgaucgagcuggacgccccgaacuaccacuacgaggagugcuccugcuaccccgacaccggcaccgugaugugcgucugccgggacaacuggcacgggagcaaccgccccuggguguccuucaaccagaaccuggacuaccagaucggcuacaucugcucgggcguguucggggacaacccccggccgaaggacggcgagggguccugcaaccccgucacgguggacggcgcggacggggugaagggcuucagcuaccgcuacggcaacggggucuggaucggccggaccaaguccaaccgccuccggaagggguucgagaugaucugggaccccaacggcuggaccgacaccgacucggacuucuccaugaagcaggacaucguggccaugacggacuggagcggguacuccggcucguucgugcagcaccccgagcugaccggccuggacugcaugcgcccgugcuucugggucgagcucgugcgggggcugccccgcgagaacaccaccaucuggacgagcggcuccucgaucuccuucugcggggugaacagcgacaccgccaacugguccuggcccgacggcgccgagcugcccuucaccaucgacaaguga

SEQ ID NO: 18188 - RNA, 1410 nt, Artificial Sequence
  derived and/or modified CDS sequence (AUadapt) from InfluenzaA__ABO52239__NA
augaaccccaaccagaagaucaucaccaucggcucggugucccugaccaucgccacggucugcuucaucaugcagaucgccauccucgcgaccaccgugacccugcacuucaagcagcacgagugcgacucgccggccuccaaccaggugaugcccugcgagcccaucaucaucgagcgcaacaucacggagaucgucuaccugaacaacaccaccaucgagaaggagaucugccccgaggccguggaguaccggaacuggucgaagccgcagugccagaucaccggguucgcccccuucuccaaggacaacagcauccgccucuccgccggcggggacaucugggugacgcgggagcccuacgucucgugcgaccccggcaagugcuaccaguucgcgcuggggcagggcaccacccuggacaacaagcacuccaacggcaccauccacgaccgcaucccgcaccggacgcuccugaugaacgagcugggggugcccuuccaccucggcaccaagcaggucugcguggccuggucguccucguccugccacgacgggaaggccuggcugcacgugugcgugaccggcgacgacaagaacgccaccgcgagcuucaucuacgacgggcgccuggucgacuccaucggcucguggucccagaacauccuccggacgcaggagucggagugcgugugcaucaacgggaccugcaccguggucaugaccgacggcuccgccagcggccgcgccgacacgcggauccuguucaucaaggaggggaagaucgugcacaucucgccccuguccggcucggcccagcacguggaggagugcuccugcuacccccgcuacccggacguccggugcaucugccgcgacaacuggaagggcucgaaccggcccgugaucgacaucaacauggaggacuacuccaucgacagcuccuacgugugcucggggcucgucggcgacacgccccgcaacgacgacuccucguccaacagcaacugccgggaccccaacaacgagcgcgggaacccgggcgugaaggggugggccuucgacaacggcgacgacguguggaugggccggaccaucaacaaggacucccgcucgggguacgagaccuucaaggucaucggcgggugguccacccccaacucgaagucccaggugaaccggcaggucaucguggacaacaacaacuggucgggcuacuccgggaucuucagcguggagggcaagucgugcaucaaccgcugcuucuacgucgagcugauccggggccgcccccaggagacccgcgugugguggaccuccaacucgaucguggucuucugcgggaccuccggcacguacgggaccggcagcuggcccgacggggcgaacaucaacuucaugccgaucuga

SEQ ID NO: 18189 - RNA, 1410 nt, Artificial Sequence; identical to SEQ ID NO: 18185
  derived and/or modified CDS sequence (AUadapt) from InfluenzaA__ABO52250__NA

SEQ ID NO: 18190 - RNA, 1413 nt, Artificial Sequence
  derived and/or modified CDS sequence (AUadapt) from InfluenzaA__ABO52261__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucaacaacacgaacguggucgccgggaaggacaccaccuccgugacccuggcgggcaacucgucccugugcccgauccggggcugggccaucuacagcaaggacaacuccauccgcaucgggagcaagggcgacguguucgucauccgggagcccuucaucuccugcucgcaccucgagugccgcacguucuuccugacccagggggcccugcucaacgacaagcacuccaacggcaccgugaaggaccggagccccuaccgcgcccugauguccugccccaucggggaggccccgucgcccuacaacucccgguucgagagcguggcguggucggccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagagcgagugcgugugcgucaacggcuccugcuucaccaucaugacggacgggcccucgaacggcccggccuccuaccggaucuucaagaucgagaaggggaagaucaccaagagcaucgagcuggacgcccccaacucccacuacgaggagugcucgugcuaccccgacaccggcaccgugaugugcgugugccgcgacaacuggcacggguccaaccggcccugggucagcuucaaccagaaccucgacuaccagaucggcuacaucugcuccggcguguucggggacaacccgcgccccaaggacggcaaggggucgugcgaccccgugacggucgacggcgccgacggggugaagggcuucuccuaccgguacggcaacgggguguggaucggccgcaccaagagcaacuccagccggaagggguucgagaugaucugggaccccgacggcuggaccgacaccgacuccaacuuccuggucaagcaggacgugguggccaugacggacuggucgggguacagcggcuccuucguccagcacccggagcugaccggccucgacugcauccgccccugcuucuggguggagcugauccgggggcgcccccgggagaagaccaccaucuggacgucgggcuccagcaucuccuucugcggggucaacagcgacaccgugaacugguccuggcccgacggcgcggagcugccguucaccaucgacaaguga

SEQ ID NO: 18191 - RNA, 1413 nt, Artificial Sequence
  derived and/or modified CDS sequence (AUadapt) from InfluenzaA__ABO52283__NA
augaaccccaaccagaagaucaucaccaucggcucgaucugcaugaccaucgggacgaucucccugauccuccagaucggcaacaucaucagcaucuggaucucccacucgauccagaccgggucccagaaccacaccggcaucugcaaccagcgcaucaucaccuacgagaacaacacgugggugaaccagaccuacgucaacaucagcaacaccaacgugguggccgggaaggacaccacguccaugauccuggccggcaacagcucccugugcccgauccggggcugggcgaucuacucgaaggacaacuccauccgcaucgggagcaagggcgacgucuucgugauccgggagcccuucaucuccugcucgcaccucgagugccgcaccuucuuccugacccagggggcccugcucaacgacaagcacuccaacggcaccgugaaggaccggagccccuaccgcgcccugauguccugccccaucggggaggccccgagccccuacaacucccgguucgagucggucgccuggagcgcguccgccugccacgacggcaugggcuggcugacgaucgggaucagcggccccgacgacggggccguggccgugcucaaguacaacggcaucaucaccgagaucaucaaguccuggcgcaagcagauccugcggacccaggagucggagugcgucugcgugaacggcuccugcuucaccaucaugacggacgggcccagcgacggcccggcguccuaccgcaucuucaagaucgagaaggggaagaucaccaagucgaucgagcuggacgcccccaacucccacuacgaggagugcagcugcuaccccgacaccggcaaggugaugugcgucugccgggacaacuggcacggguccaaccgccccugggugagcuucaaccagaaccucgacuaccagaucggcuacaucugcuccggcguguucggggacaacccgcggcccaaggacggcaaggggucgugcgaccccgucaacguggacggcgccgacggggugaagggcuucuccuaccgcuacggcgacggggucuggaucggccggaccaagagcaacuccucgcgcaagggguucgagaugaucugggaccccaacggcuggacggacaccgacgacaacuuccuggugaagcaggacguggucgccaugaccgacugguccggguacagcggcagcuucgugcagcacccggagcugaccggccucgacugcaugcggcccugcuucuggguggagcugauccgcgggcggccccgcgagaagacgaccaucuggaccuccggcucguccaucagcuucugcggggucaacuccgacaccgugaacuggagcuggcccgacggcgccgagcugccguucacgaucgacauguga

SEQ ID NO: 18192 - RNA, 1410 nt, Artificial Sequence; identical to SEQ ID NO: 17920
  derived and/or modified CDS sequence (AUadapt) from InfluenzaA__ABO52294__NA

SEQ ID NO: 18193 - RNA, 1410 nt, Artificial Sequence
  derived and/or modified CDS sequence (AUadapt) from InfluenzaA__ABO52316__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccagaucaugcccugcgagcccacgaucaucgagcgcaacaucaccgagaucguguaccucaccaacaucaccaucgagaaggagaucugccccaagcuggucgaguaccggaacugguccaagccgcagugcaagaucacgggguucgcccccuucagcaaggacaacuccauccgccugucggccggcggggacaucugggugacccgggagcccuacguguccugcgaccccagccgcugcuaccaguucgcccucggccaggggaccacccuggacaacaagcacuccaacgacacgauccacgaccggaccccgcaccgcacccugcucaugaacgagcugggcguccccuuccaccugggcacccgccaggugugcaucgccuggucguccucguccugccacgacgggaaggcguggcuccacgugugcgucacgggcuacgacaagaacgccaccgccagcuucaucuacgacgggcggcugguggacuccaucggcucguggucccagaacauccugcggacccaggagagcgagugcgugugcaucaacgggaccugcacggucgugaugaccgacggcuccgccucgggccgcgcggacaccaagauccucuucaucgaggaggggaagaucgugcacaucucgccccuguccggcagcgcccagcacgucgaggagugcuccugcuacccccgguacccgggggugcgcugcaucugccgggacaacuggaagggcucgaaccgccccguggucgacaucaacgugaaggacuacuccaucgacagcuccuacgugugcucgggccuggucggggacacgccccggaagaacgaccgcuccucgaacuccuacugccggaaccccaacaacgagaagggcaaccacggggugaagggcugggccuucgacgacgggaacgacguguggaugggccgcaccaucagcgaggacucccggucgggcuacgagaccuucaaggucaucgggggcugguccaccccgaacagcaagcuccagaucaaccgccaggugaucgucgacuccgacaaccggucgggguacuccggcaucuucucgguggagggcaagagcugcaucaaccgcugcuucuacguggagcugauccgcgggcgggagcaggagacccgcgucugguggacguccaacucgaucgugguguucugcggcaccuccgggaccuacggcgccgggagcuggcccgacggcgccgacaucaaccugaugcccaucuga

SEQ ID NO: 18194 - RNA, 1410 nt, Artificial Sequence; identical to SEQ ID NO: 16516
  derived and/or modified CDS sequence (AUadapt) from InfluenzaA__ABO52327__NA

SEQ ID NO: 18195 - RNA, 1410 nt, Artificial Sequence
  derived and/or modified CDS sequence (AUadapt) from InfluenzaA__ABO52338__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacagcaacgacacgauccacgaccgcaccccgcaccggacccugcucaugaacgagcugggcgugcccuuccaccuggggacccgccaggugugcaucgccugguccucguccucgugccacgacggcaaggcguggcuccacgucugcgugacgggguacgacaagaacgccaccgccuccuucaucuacgacggccggcugguggacagcaucggguccuggucgaagaacauccugcgcacccaggaguccgagugcgucugcaucaacgggaccugcacgguggugaugaccgacggcagcgccuccggccgggcggacaccaagauccucuucaucgaggagggcaagaucguccacaucucgccccugucgggguccgcccagcacguggaggagugcagcugcuacccccgcuacccgggcgugcggugcaucugccgcgacaacuggaagggcuccaaccggcccgucguggacaucaacgugaaggacuacucgaucgacuccagcuacgucugcuccgggcuggugggcgacacgccccgcaacaacgaccggucguccucguccuacugccgcaaccccaacaacgagaaggggaaccacggcgugaaggggugggccuucgacgacggcaacgacgucuggaugggccggaccaucagcgaggacucccgcucgggguacgagaccuucaaggugaucggcgggugguccaccccgaacagcaagcuccagaucaaccggcaggucaucguggacuccgacaaccgcucgggcuacuccgggaucuucucgguggagggcaagagcugcaucaaccggugcuucuacgucgagcugauccgcggccgcgagcaggagacccgggugugguggacguccaacucgaucguggucuucugcgggaccuccggcaccuacgggaccggcagcuggcccgacggggccgacaucaaccugaugcccaucuga

SEQ ID NO: 18196 - RNA, 1410 nt, Artificial Sequence
  derived and/or modified CDS sequence (AUadapt) from InfluenzaA__ABO52349__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacgucacggagaucguguaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggucacccgggagcccuacguguccugcgaccccggcaagugcuaccaguucgcccucgggcagggcaccacccuggacaacaagcacagcaacgacacgauccacgaccgcaccccguaccggacccugcucaugaacgagcugggcgugcccuuccaccuggggacccgccaggucugcaucgccugguccucguccagcugccacgacggcaaggcguggcuccacgugugcgugacgggguacgacaagaacgccaccgccuccuucaucuacgacggccggcuggucgacucgaucggguccuggagcaagaacauccugcgcacccaggaguccgagugcgugugcaucaacgggaccugcacgguggucaugaccgacggcucggccuccgagcgggcggacaccaagauccucuucaucgaggaggggaagaucauccacaucagcccccugucgggcuccgcccagcacguggaggagugcagcugcuacccccgcuacccgggggugcggugcaucugccgcgacaacuggaagggcuccaaccggcccgucguggacaucaacaugcgcgacuacucgaucguguccagcuacgucugcuccggccuggugggggacacgccccggaagaacgaccgcucguccagcuccuacugccggaaccccaacaacgagaagggcaaccacggggugaagggcugggccuucgacgacgggaacgacgucuggaugggccgcaccaucucggaggagucccggagcggcuacgagaccuucaaggugaucgggggcugguccaccccgaacucgaagcuccagaucaaccgccaggucaucguggacuccaacaaccggagcggguacuccggcaucuucucgguggagggcaagagcugcaucaaccgcugcuucuacgucgagcugauccgcggccgggagcaggagacccgcgugugguggacguccaacucgaucguggucuucugcggcaccuccgggaccuacggcaccgggagcuggcccgacggcgccgacaucaaccugaugcccaucuga

SEQ ID NO: 18197 - RNA, 1410 nt, Artificial Sequence
  derived and/or modified CDS sequence (AUadapt) from InfluenzaA__ABO52360__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcaacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 18198 - RNA, 1410 nt, Artificial Sequence
  derived and/or modified CDS sequence (AUadapt) from InfluenzaA__ABO52371__NA
augaaccccaaccagaagaucaucaccaucggcucggugucccugaccaucgccacggucugcuuccucaugcagaucgccauccuggugaccaccgugacccugcacuuccgccaguacgagugcgacucgccggcgaacaaccaggucaugcccugcgagcccaucaucaucgagcggaacaucacggagaucguguaccucaacaacaccaccaucgagaaggagaucugccccaagcugguggaguaccgcaacugguccaagccgcagugcaagaucaccggguucgcccccuucucgaaggacaacuccauccggcugagcgccggcggggacaucugggucacgcgcgagcccuacguguccugcgaccccggcaagugcuaccaguucgcccucgggcagggcaccacccuggacaacaagcacucgaacgacaccauccacgaccggaucccgcaccgcacgcugcucaugaacgagcugggcgugcccuuccaccuggggacccggcaggucugcaucgccugguccucguccucgugccacgacggcaaggcguggcuccacgugugcgugaccggggacgacaagaacgccaccgccuccuucaucuacgacggcaagcuggucgacagcaucggguccuggucgcagaacauccugcgcacgcaggaguccgagugcgugugcaucaacgggaccugcaccguggucaugaccgacggcucggccuccggccgggcggacacgcgcauccucuucaucgaggagggcaagaucgugcacaucucgccccugagcggguccgcccagcacguggaggagugcucgugcuacccccgguacccgggcguccgcugcaucugccgggacaacuggaagggcuccaaccgccccgugguggacaucaacgucgaggacuacucgaucgacuccucguacgugugcuccgggcuggugggcgacacgccccggaacaacgaccgcagcgggaacuccaacugccggaaccccaacaacgagcgcggcaaccacggggucaagggcugggccuucgacgacggcaacgacguguggauggggcggaccaucaacaaggaccuccgcucgggcuacgagaccuucaaggucaucgggggcugguccaccccgaacucgaagucccagaucaaccgccaggugaucguggacucggacaaccgguccggguacagcggcaucuucuccgucgagggcaagucgugcaucaaccgcugcuucuacguggagcugauccgggggcgcgagcaggagacccgggugugguggaccuccaacucgaucgucguguucugcggcaccagcgggacguacggcaccggguccuggcccgacggcgccgacaucaaccugaugcccaucuga

SEQ ID NO: 18199 - RNA, 1413 nt, Artificial Sequence
  derived and/or modified CDS sequence (AUadapt) from InfluenzaA__ABO52800__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccgugacgcuggccggcaacucgucccugugcccgauccggggcugggcgaucuacagcaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgcccuaccgcgcccugauguccugccccaucggggaggccccgagccccuacaacucccgguucgagucgguggccuggagcgcguccgccugccacgacggcaugggcuggcugacgaucgggaucagcggccccgacgacggggccgucgccgugcucaaguacaacggcaucaucaccgagaccaucaaguccuggcgcaagcggauccugcgcacccaggagucggagugcgugugcgucaacggcuccugcuucacgaucaugaccgacgggcccagcaacggcccggcguccuaccggaucuucaagaucgagaaggggaagaucaccaagucgaucgagcuggacgcccccaacucccacuacgaggagugcagcugcuaccccgacaccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcgaccccgugaccgucgacggcgccgacggggugaagggcuucuccuaccgguacggcaacgggguguggaucggccgcaccaagucgaacuccagccggaagggguucgagaugaucugggaccccaacggcuggaccgacacggacuccaacuuccuggucaagcaggacgugguggccaugaccgacuggucgggguacagcggcuccuucguccagcacccggagcugaccggccucgacugcaugcgccccugcuucuggguggagcugauccgggggcgcccccgggagcgcaccacgaucuggaccucgggcuccagcaucuccuucugcggggucaacagcgacaccgccaacugguccuggcccgacggcgcggagcugccguucaccaucgacaaguga

SEQ ID NO: 18200 - RNA, 1413 nt, Artificial Sequence; identical to SEQ ID NO: 17230
  derived and/or modified CDS sequence (AUadapt) from InfluenzaA__ABP49220__NA

SEQ ID NO: 18201 - RNA, 1413 nt, Artificial Sequence
  derived and/or modified CDS sequence (AUadapt) from InfluenzaA__ABP49319__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacaacaccugggucaaccagaccuacgugaacaucagcaacacgaacguggucgccgggaaggacaccaccuccaugauccuggcgggcaacucgucccugugcccgauccggggcugggccaucuacagcaaggacaacuccauccgcaucgggagcaagggcgacguguucgugauccgggagcccuucaucuccugcucgcaccucgagugccgcaccuucuuccugacgcagggggcccugcucaacgacaagcacuccaacggcaccgucaaggaccggagccccuaccgcgcccugauguccugccccaucggggaggccccgucgcccuacaacucccgguucgagagcguggcguggucggccuccgccugccacgacggcaugggcuggcugaccaucgggaucagcggccccgacgacggggccguggcgguccucaaguacaacggcaucaucaccgagacgaucaaguccuggcgcaagcagauccugcggacccaggagagcgagugcgugugcgugaacggcuccugcuucaccaucaugaccgacgggcccucggacggcccggccuccuaccgcaucuucaagaucgagaaggggaagaucaccaagagcaucgagcuggacgcccccaacucccacuacgaggagugcucgugcuaccccgacacgggcaaggucaugugcgugugccgggacaacuggcacggguccaaccgccccugggugagcuucaaccagaaccucgacuaccagaucggcuacaucugcuccggcgucuucggggacaacccgcggcccaaggacggcaaggggucgugcgaccccgugaacguggacggcgccgacggggucaagggcuucuccuaccgcuacggcaacgggguguggaucggccggaccaagagcaacuccagccgcaagggguucgagaugaucugggaccccaacggcuggaccgacacggacgggaacuuccuggugaagcaggacgucguggccaugaccgacugguccggcuacucgggcagcuucgugcagcacccggagcugaccgggcucgacugcaugcggcccugcuucugggucgagcugauccgcggccggccccgcgagaagaccacgaucuggaccuccgggucguccaucagcuucugcggcgugaacuccgacaccgucaacuggagcuggcccgacggcgcggagcugccguucaccaucgacaaguga

SEQ ID NO: 18202 - RNA, 1410 nt, Artificial Sequence
  derived and/or modified CDS sequence (AUadapt) from InfluenzaA__ABP49330__NA
augaaccccaaccagaagaucaucaccaucggcucgaucugcaugguggucgggaucaucucccugauccuccagaucggcaacaucaucagcaucuggaucucccacagcauccagaccgggucccagaaccacacgggcaucugcaaccagagcaucaucaccuacaagaacuccaccugggugaaccagaccuacgugaacaucagcaacacgaacgucguggccgggaagggcaccaccccggugauccuggccggcaacuccucgcugugccccauccgcgggugggcgaucuacuccaaggacaacggcauccggaucgggagcaagggcgacgucuucgugauccgcgagcccuucaucuccugcagccaccucgagugccggaccuucuuccugacgcagggggcccugcucaacgacaagcacuccaacggcaccgugaaggaccgcagccccuaccgggcccugauguccugcccggucggcgaggcccccagccccuacaacucccgcuucgagucgguggccuggagcgcgugcgccugccacgacgggaugggcuggcugaccaucgggaucuccggccccgacgacgaggccguggccguccucaaguacaacggcaucaucaccgagacgaucaagagcuggcggaagaagauccugcgcacccaggaguccgagugcgugugcgugaacgggagcugcuucaccaucaugaccgacggcccguccgacgggcccgcgagcuacaagaucuucaagaucgagaagggcaaggucacgaaguccaucgagcuggacgcccccaacucgcacuacgaggagugcuccugcuaccccgacaccgggaaggugaugugcgugugccgggacaacuggcacggcagcaaccgcccgugggucuccuucgaccagaaccucgacuaccagaucggcuacaucugcagcgggguguucggcgacaacccccggcccaaggacgggaagggcuccugcgggcccguguacgucgacggcgccaacggcgugaagggguucagcuaccgcuacggcaacgggguguggaucggccggaucaaguccaacagcucccgccagggguucgagaugaucugggacccgaacggcuggaccgagaccgacucguccuucuucgucaagcaggacguggucgccaugacggacuggagcggcuacagcggguccuucgugcagcaccccgagcugaccggccuggacugcaugcggcccugcuucuggguggagcucauccgcgggcggcccaaggagaagaccaucuggaccagcggcuccagcaucuccuucugcggcgucaacagcgacacgguggacugguccuggccggacggggccgagcugcccuucaccaucgacaaguga

SEQ ID NO: 18203 - RNA, 1413 nt, Artificial Sequence
  derived and/or modified CDS sequence (AUadapt) from InfluenzaA__ABP49352__NA
augaaccccaaccagaagaucaucaccaucggcucgaucugcaugaccaucgggaucaucucccugauccuccagaucggcaacaucaucagcaucugggugucccacucgauccagacggggucccagaaccacaccggcaucugcaaccagcgcaucaucaccuacgagaacagcaccugggucaaccagacguacgugaacaucaacaacaccaacguggucgccgggaaggacaccaccuccguggcccuggcgggcaacucgucccugugcccgauccggggcugggccaucuacagcaaggacaacuccauccgcaucgggucgaagggcgacguguucgucauccgggagcccuucaucuccugcagccaccucgagugccgcacguucuuccugacccagggggcccugcucaacgacaagcacuccaacggcaccgugaaggaccggucgcccuaccgcgcccugauguccugccccaucggggaggccccgagccccuacaacucccgguucgagucgguggcguggagcgccuccgccugccacgacggcaugggcuggcugaccaucgggaucagcggccccgacgacggggccgucgcggugcucaaguacaacggcaucaucacggagaccaucaaguccuggcgcaagcggauccugcgcacccaggagucggagugcgugugcgucaacggcuccugcuucaccaucaugacggacgggcccagcgacggcccggccuccuaccggaucuucaagaucgagaaggggaagaucaccaagucgaucgagcuggacgcccccaacucccacuacgaggagugcagcugcuaccccgacaccggcaccgugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcggccccgugacggucgacggggccgacggcgugaagggcuucuccuacaaguacgggaacggcguguggaucgggcggaccaagucgaacuccagccgcaagggcuucgagaugaucugggaccccaacggguggaccgacaccgacuccaacuuccuggucaagcaggacgugguggccaugacggacuggucgggcuacagcggcuccuucguccagcacccggagcugaccgggcucgacugcaugcggcccugcuucuggguggagcugauccgcggccggccccgcgagcggaccaccaucuggacgucgggguccagcaucuccuucugcggcgucgacagcgacaccgcgaacugguccuggcccgacggcgccgagcugccguucaccaucgacaaguga

SEQ ID NO: 18204 - RNA, 1413 nt, Artificial Sequence; identical to SEQ ID NO: 18100
  derived and/or modified CDS sequence (AUadapt) from InfluenzaA__ABP49363__NA

SEQ ID NO: 18205 - RNA, 1410 nt, Artificial Sequence; identical to SEQ ID NO: 17132
  derived and/or modified CDS sequence (AUadapt) from InfluenzaA__ABP49374__NA

SEQ ID NO: 18206 - RNA, 1413 nt, Artificial Sequence
  derived and/or modified CDS sequence (AUadapt) from InfluenzaA__ABP49385__NA
augaaccccaaccagaagaucaucaccaucggcucgaucuccguggccaucgggaucaucaaccugacccuccagaucggcaacaucaucucgaucugggccucccacagcauccagacggggucccagaacuacaccggcaucugcaaccagcgcaucaucaccuacgagaaccggaccugggucaaccagacguacgugaacaucaacaacaccaacguggucgcggggaaggacaagaccucgaugacccuggccggcaacuccagccugugcccgauccgcggcugggccaucuacacgaaggacaacuccauccggaucgggucgaagggcgacguguucgugauccgcgagcccuucaucuccugcagccaccucgagugccggaccuucuuccugacccagggggcccugcucaacgacaagcacuccaacggcaccaucaaggaccgcucgcccuuccgggcccugauguccugcccccugggggaggcgccgagccccuacaacucccgcuucgagucggucgccugguccgccagcgccugccacgacggccucggcuggcugacgaucgggaucucgggccccgacaacggggcgguggccgugcugaaguacaacggcaucaucaccgagaccaucaaguccuggaagaagcagauccuccggacccaggagucggagugcgucugcgugaacggcuccugcuucacgaucaugaccgacgggcccagcaaccgcgccgccuccuaccggaucuucaagaucgagaagggccgcgugaccaagucgaucgagcuggacgccccgaacuaccacuacgaggagugcuccugcuaccccgacaccgggacggucaugugcgugugccgggacaacuggcacggcagcaaccgccccuggguguccuucaaccagaaccuggacuaccagaucggguacaucugcucgggcgucuucggcgacaacccccggccgaaggacggggagggcuccugcaaccccgugaccguggacggggcggacggcgucaagggguucagcuaccgcuacggcaacggcguguggaucgggcggaccaaguccaaccgccuccggaagggcuucgagaugaucugggaccccaacggguggaccgacacggacucggacuucuccaugaagcaggacguggucgccaugaccgacuggagcggcuacuccgggucguucgugcagcaccccgagcugaccggccuggacugcaugcgcccgugcuucuggguggagcucguccggggccugccccgcgagaacaccacgaucuggaccuccgggagcucgaucuccuucugcggcgugaacagcgagaccgccaacugguccuggcccgacggggccgagcugcccuucaccaucgacaaguga

SEQ ID NO: 18207 - RNA, 1413 nt, Artificial Sequence; identical to SEQ ID NO: 16788
  derived and/or modified CDS sequence (AUadapt) from InfluenzaA__ABP49396__NA

SEQ ID NO: 18208 - RNA, 1410 nt, Artificial Sequence
  derived and/or modified CDS sequence (AUadapt) from InfluenzaA__ABP49407__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugucggagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagcugcgcagcggcuacgagaccuucaaggucaucgaggggugguccaaccccaacucgaagcugcagaucaaccgccaggugaucguggaccggggcaaccgguccggguacagcggcaucuucucggucgaggggaagaucugcaucaaccgcugcuucuacguggagcucauccggggccgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18209 - RNA, 1410 nt, Artificial Sequence; identical to SEQ ID NO: 17132
  derived and/or modified CDS sequence (AUadapt) from InfluenzaA__ABP49418__NA

SEQ ID NO: 18210 - RNA, 1410 nt, Artificial Sequence; identical to SEQ ID NO: 17132
  derived and/or modified CDS sequence (AUadapt) from InfluenzaA__ABP49429__NA

SEQ ID NO: 18211 - RNA, 1410 nt, Artificial Sequence
  derived and/or modified CDS sequence (AUadapt) from InfluenzaA__ABP49440__NA
augaaccccaaccagaagaucaucaccaucggcucggugucccugaccaucgccacggucugcuuccucauccagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggucgaagccgcagugccagaucaccggguucgcccccuucuccaaggacaacagcauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacgcaggagagcgagugcgugugcaucaacgggaccugcaccgucgugaugaccgacggcuccgcgucgggccgggccgacacgcgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcagcgggcuggucggcgacacgccccggaacgacgacuccucguccaacucgaacugccgcgaccccaacaacgagcgggggaacccgggcgugaaggggugggccuucgacaacggcgacgacguguggaugggccgcaccaucuccaaggacagccgguccggguacgagaccuucaaggucaucggcggguggucgacccccaacuccaagucgcaggccaaccgccaggugaucgucgacaagaacaacugguccggcuacagcgggaucuucucgguggagggcaaguccugcaucaaccggugcuucuacguggagcugauccgcggccgcccccaggagacccgggucugguggaccucgaacuccaucgugguguucugcgggaccagcggcacguacgggaccggcuccuggcccgacggggcgaacaucaacuucaugccgaucuga

SEQ ID NO: 18212 - RNA, 1413 nt, Artificial Sequence; identical to SEQ ID NO: 17353
  derived and/or modified CDS sequence (AUadapt) from InfluenzaA__ABP49451__NA

SEQ ID NO: 18213 - RNA, 1410 nt, Artificial Sequence
  derived and/or modified CDS sequence (AUadapt) from InfluenzaA__ABP49462__NA
augaaccccaaccagaagaucaucaccaucggcucggugucccugaccaucgccacggucugcuucaucaugcagaucgccauccucgcgaccaccgugacccugcacuucaagcagcacgagugcgacucgccggccuccaaccaggugaugcccugcgagcccaucaucaucgagcgcaacaucacggagaucgucuaccugaacaacaccaccaucgagaaggagaucugccccgaggccguggaguaccggaacuggucgaagccgcagugccagaucaccggguucgcccccuucuccaaggacaacagcauccgccucuccgccggcggggacaucugggugacgcgggagcccuacgucucgugcgaccccggcaagugcuaccaguucgcgcuggggcagggcaccacccuggacaacaagcacuccaacggcaccauccacgaccgcaucccgcaccggacgcuccugaugaacgagcugggggugcccuuccaccucggcaccaagcaggucugcguggccuggucguccucguccugccacgacgggaaggccuggcugcacgugugcgugaccggcgacgaccgcaacgccaccgcgagcuucaucuacgacgggcggcuggucgacuccaucggcucguggucccagaacauccuccgcacgcaggagucggagugcgugugcaucaacgggaccugcaccguggucaugaccgacggcuccgccagcggccgggccgacacgcgcauccuguucaucaaggaggggaagaucgugcacaucucgccccuguccggcucggcccagcacaucgaggagugcuccugcuacccccgguacccggacgugcgcugcaucugccgggacaacuggaagggcucgaaccgccccgucaucgacaucaacauggaggacuacuccaucgacagcuccuacgugugcucggggcucgugggcgacacgccccggaacgacgacuccucguccaacagcaacugccgcgaccccaacaacgagcgggggaacccgggcgucaaggggugggccuucgacaacggcgacgacguguggaugggccgcaccaucaacaaggacucccggucgggguacgagaccuucaaggugaucggcgggugguccacccccaacucgaagucccaggucaaccgccaggugaucgucgacaacaacaacuggucgggcuacuccgggaucuucagcguggagggcaagucgugcaucaaccggugcuucuacguggagcugauccgcggccgcccccaggagacccgggucugguggaccuccaacucgaucgugguguucugcgggaccuccggcacguacgggaccggcagcuggcccgacggggcgaacaucaacuucaugccgaucuga

SEQ ID NO: 18214 - RNA, 1410 nt, Artificial Sequence; identical to SEQ ID NO: 18162
  derived and/or modified CDS sequence (AUadapt) from InfluenzaA__ABP49473__NA

SEQ ID NO: 18215 - RNA, 1410 nt, Artificial Sequence
  derived and/or modified CDS sequence (AUadapt) from InfluenzaA__ABP49495__NA
augaaccccaaccagaagaucaucaccaucggcucggugucccugaccaucgccacgaucugcuuccucaugcagaucgccauccuggucaccaccgugacccugcacuucaagcaguacgagugcgacucgccggcgaacaaccaggugaugcccugcgagcccaucaucaucgagcgcaacaucacggagaucgucuaccucaccaacaccaccaucgagaaggagaucugccccaagcugguggaguaccggaacugguccaagccgcagugcaagaucacgggguucgcccccuucagcaaggacaacuccauccgccugucggccggcggggacaucugggugacccgggagcccuacgucuccugcgaccccggcaagugcuaccaguucgcccucgggcagggcaccacccuggacaacaagcacucgaacgacacgauccacgaccgcaccccgcaccggacccugcucaugaacgagcugggcgugcccuuccaccuggggacccgccaggugugcaucgccugguccagcuccucgugccacgacggcaaggcguggcuccacgucugcgugacgggguacgacaagaacgccaccgccuccuucaucuacgacggccggcugguggacucgaucggguccuggagccagaacauccugcgcacccaggaguccgagugcgucugcaucaacgggaccugcacgguggugaugaccgacggcucggccuccggccgggcggacaccaagauccucuucaucgaggagggcaagaucguccacaccucgccccugagcggguccgcccagcacguggaggagugcucgugcuacccccgcuacccgggcgugcggugcaucugccgcgacaacuggcggggcuccaaccgccccgucguggacaucaacgugaaggacuacagcaucgacuccucguacgucugcuccgggcuggugggcgacacgccccggaacaacgaccgcucguccagcuccuacugccggaaccccaacaacgagaaggggacccacggcgugaaggggugggccuucgacgacggcaacgacgucuggaugggccgcaccaucucggaggacucccggucgggguacgagaccuucaaggugaucggcgggugguccacgccgaacagcaagcuccagaucaaccgccaggucaucguggacuccgacaaccggucgggcuacuccgggaucuucucgguggagggcaagagcugcaucaaccgcugcuucuacgucgagcugauccgcggccgggagcaggagacccgcgugugguggaccuccaacucgaucguggucuucugcgggaccuccggcacguacgggaccggcagcuggcccgacggggccgacaucaaccugaugcccaucuga

SEQ ID NO: 18216 - RNA, 1410 nt, Artificial Sequence; identical to SEQ ID NO: 16505
  derived and/or modified CDS sequence (AUadapt) from InfluenzaA__ABP49506__NA

SEQ ID NO: 18217 - RNA, 1410 nt, Artificial Sequence; identical to SEQ ID NO: 16337
  derived and/or modified CDS sequence (AUadapt) from InfluenzaA__ABP49517__NA

SEQ ID NO: 18218 - RNA, 1413 nt, Artificial Sequence
  derived and/or modified CDS sequence (AUadapt) from InfluenzaA__ABQ01314__NA
augaaccccaaccagaagaucaucaccaucggcucgaucugcauggccaucgggaccaucucccugauccuccagaucggcaacaucaucagcaucugggugucccacucgauccagacggggucccagaaccacaccggcaucugcaaccagcgcaucaucaccuacgagaacaacaccugggucaaccagacguacgugaacaucagcaacaccaacguggucgccgggaaggacaccaccuccaugauccuggcgggcaacucgucccugugcccgauccggggcugggccaucuacagcaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugccccaucggggaggccccgucgcccuacaacucccgguucgagagcguggcguggucggccuccgccugccacgacggcaugggcuggcugaccaucgggaucagcggccccgacgacggggccguggcgguccucaaguacaacggcaucaucacggagaucaucaaguccuggcgcaagcagauccugcggacccaggagagcgagugcgugugcgugaacggcuccugcuucaccaucaugaccgacgggcccucggacggcccggccuccuaccgcaucuucaagaucgagaaggggaagaucaccaagagcaucgagcuggacgcccccaacucccacuacgaggagugcucgugcuaccccgacacgggcaaggucaugugcgugugccgggacaacuggcacggguccaaccgccccugggugagcuucaaccagaaccucgacuaccagaucggcuacaucugcuccggcgucuucggggacaacccgcggcccaaggacggcaaggggucgugcgaccccgugaacguggacggcgccgacggggucaagggcuucuccuaccgcuacggcaacgggguguggaucggccggaccaagagcaacuccagccgcaagggguucgagaugaucugggaccccaacggcuggaccgacacggacgggaacuuccuggugaagcaggacgucguggccaugaccgacugguccggcuacucgggcagcuucgugcagcacccggagcugaccgggcucgacugcaugcggcccugcuucugggucgagcugauccgcggccggccccgcgagaagaccacgaucuggaccuccgggucguccaucagcuucugcggcgugaacuccgacaccgucaacuggagcuggcccgacggcgcggagcugccguucaccaucgacaaguga

SEQ ID NO: 18219 - RNA, 1413 nt, Artificial Sequence
  derived and/or modified CDS sequence (AUadapt) from InfluenzaA__ABQ01325__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacagcauccgcaucggguccaagggcgacguguucgugauccgggagcccuucaucucgugcucccaccucgagugccgcacguucuuccugacccagggggcccugcucaacgacaagcacagcaacggcaccgucaaggaccggucccccuaccgcgcccugaugucgugccccaucggggaggccccgucccccuacaacagccgguucgagagcguggcgugguccgccucggccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcucgugcuucaccaucaugacggacgggcccuccgacggccaggccagcuaccgcaucuucaagaucgagaaggggaagaucaccaaguccaucgagcuggacgccccgaacagccacuacgaggagugcuccugcuaccccgacaccggcaccgucaugugcgugugccgggacaacuggcacgggucgaaccgccccuggguguccuucaaccagaaccucgacuaccagaucggcuacaucugcagcggcgucuucggggacaacccccggccgaaggacggcaagggguccugcgaccccgugaacguggacggcgccgacggggucaagggcuucucguaccgcuacggcaacgggguguggaucggccggacgaaguccaacagcucccgcaagggguucgagaugaucugggaccccaacggcuggaccgacaccgacagcaacuuccuggugaagcaggacgucguggccaugaccgacuggucgggguacuccggcagcuucgugcagcaccccgagcugacgggccucgacugcaugcggccgugcuucugggucgagcugauccgcgggcggccccgcgagaagaccaccaucuggaccuccggcucguccaucagcuucugcggggugaacuccgacacggucaacuggagcuggcccgacggcgcggagcugcccuucaccaucgacaaguga

SEQ ID NO: 18220 - RNA, 1410 nt, Artificial Sequence; identical to SEQ ID NO: 17132
  derived and/or modified CDS sequence (AUadapt) from InfluenzaA__ABQ01336__NA

SEQ ID NO: 18221 - RNA, 1410 nt, Artificial Sequence; identical to SEQ ID NO: 17132
  derived and/or modified CDS sequence (AUadapt) from InfluenzaA__ABQ01347__NA

SEQ ID NO: 18222 - RNA, 1410 nt, Artificial Sequence
  derived and/or modified CDS sequence (AUadapt) from InfluenzaA__ABQ01358__NA
augaaccccaaccagaagaucaucaccaucggcucggugucccugaccaucgccacggucugcuuccucaugcagaucgccauccuggcgaccaccgugacccugcacuucaagcagcacgagugcaacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccucguccugccacgacgggaaggccuggcugcacgugugcgucaccggcgacgaccgcaacgccaccgccucguucaucuacgacgggcggcucgaggacuccaucggcagcuggucccagaacauccugcgcacgcaggagucggagugcgugugcaucaacgggaccugcaccguggucaugaccgacggcaacgcguccggccgggccgacacgcgcauccuguucaucaaggaggggaagaucgugcacaucucgccccucagcggcuccgcccagcacaucgaggagugcucgugcuacccccgguacccggacgugcgcugcaucugccgggacaacuggaagggcuccaaccgccccguccuggacaucagcauggaggacuacuccaucgacucguccuacgugugcucggggcuggugggcgacacgccccggaacgacgacuccagcuccaacucgaacugccgcgaccccaacaacgagcgggggaacccgggcgucaaggggugggccuucgacaacggcgacgacguguggaugggccgcaccaucuccaaggaccuccggucgggguacgagaccuucaaggugaucggcgggugguccacccccaacagcaagucccaggucaaccgccaggugaucgucgacaacaacaacuggucgggcuacuccgggaucuucucgguggagggcaagagcugcaucaaccggugcuucuacguggagcugauccgcggccgcucccaggagacccgggucugguggaccucgaacuccaucgugguguucugcgggaccagcggcacguacgggaccggcuccuggcccgacggggccaacaucaacuucaugcccaucuga

SEQ ID NO: 18223 - RNA, 1410 nt, Artificial Sequence
  derived and/or modified CDS sequence (AUadapt) from InfluenzaA__ABQ01369__NA
augaaccccaaccagaagaucaucaccaucggcucggugucccugaccaucgccacgaucugcuucgucaugcagaucgccauccucgugaccaccgugacccugcacuucaagcaguacgagugcgacucgccggcgaacaaccaggucaugcccugcgagcccaucaucaucgagcgcaacaucacggagaucguguaccugaccaacaccaccaucgagaaggagaucugccccaagcucguggaguaccggaacugguccaagccgcagugcaagaucacgggguucgcccccuucagcaaggacaacuccauccgccugucggccggcggggacaucugggucacccgggagcccuacguguccugcgaccccggcaagugcuaccaguucgcccuggggcagggcaccacccucgacaacaagcacucgaacgacacgauccacgaccgcaccccgcaccggacccugcugaugaacgagcucggcgugcccuuccaccuggggacccgccaggucugcaucgccugguccagcuccucgugccacgacggcaaggcguggcugcacgugugcgugacgggguacgacaagaacgccaccgccuccuucaucuacgacggccggcucgucgacucgaucggguccuggagccagaacauccugcgcacccaggaguccgagugcgugugcaucaacgggaccugcacgguggucaugaccgacggcucggccuccggccgggcggacaccaagauccuguucaucgaggagggcaagaucgugcacaccucgccccucagcggguccgcccagcacguggaggagugcucgugcuacccccgcuacccgggcguccggugcaucugccgcgacaacuggaagggcuccaaccggcccgugguggacaucaacgucaaggacuacagcaucgacuccucguacgugugcuccgggcuggugggcgacacgccccgcaagaacgaccggucguccagcuccuacugccgcaaccccaacaacgagaaggggacccacggcgucaaggggugggccuucgacgacggcaacgacguguggaugggccggaccaucucggaggacucccgcucgggguacgagaccuucaaggucaucggcgggugguccacgccgaacagcaagcugcagaucaaccgccaggugaucguggacuccgacaaccggucgggcuacuccgggaucuucucggucgagggcaagagcugcaucaaccggugcuucuacguggagcucauccgcggccgcgagcaggagacccgggugugguggaccuccaacucgaucgucguguucugcgggaccuccggcacguacgggaccggcagcuggcccgacggggccgacaucaaccugaugcccaucuga

SEQ ID NO: 18224 - RNA, 1410 nt, Artificial Sequence
  derived and/or modified CDS sequence (AUadapt) from InfluenzaA__ABQ44386__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgagccuguccgggucggcccagcacguggaggagugcuccugcuacccccgcuaccccggcgugcggugcgucugccgcgacaacuggaagggcagcaaccggccgaucguggacaucaacgugaaggacuacuccaucgucucguccuacgugugcagcgggcucgugggcgacacgccccgcaagaacgacuccucguccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagagcaaguccugcaucaaccgcugcuucuacguggagcugauccggggccgcaagcaggagaacgaggugcuguggaccucgaacuccaucgucguguucugcgggaccagcggcaccuacgggaccggcuccuggccggacggggccgacaucaaccucaugcccaucuga

SEQ ID NO: 18225 - RNA, 1410 nt, Artificial Sequence; identical to SEQ ID NO: 17116
  derived and/or modified CDS sequence (AUadapt) from InfluenzaA__ABQ44408__NA

SEQ ID NO: 18226 - RNA, 1413 nt, Artificial Sequence
  derived and/or modified CDS sequence (AUadapt) from InfluenzaA__ABQ44419__NA
augaaccccaaccagaagaucaucaccaucggcucgaucugcauggccaucgggaucaucucccugauccuccagaucggcaacaucgugagcaucuggaucucccacucgauccagaacgggucccagaacuacaccggcaucugcaaccagcgcaucaucacguacgagaacagcaccugggucaaccagaccuacgugaacaucaacaacaccaacguggucgccgggcaggacacgaccuccguggcgcuggccggcaacucgucccugugcccgaucagcggcugggccaucuacuccaaggacaacucgauccggaucggguccaagggcgacguguucgucauccgcgagcccuucaucagcugcucccaccucgagugccggaccuucuuccugacccagggggcccugcucaacgacaagcacucgaacggcacggugaaggaccgcucccccuaccgggcccugaugagcugccccaucggggaggcgccgucccccuacaacucgcgcuucgagagcguggccugguccgccagcgccugccacgacggcaugggcuggcugaccaucgggaucuccggccccgacgacggggcggucgccgugcucaaguacaacggcaucaucaccgagaccaucaagucguggcggaagcgcauccugcggacgcaggaguccgagugcgugugcgucaacggcagcugcuucaccaucaugaccgacgggcccaacaacggcccggccuccuacaagaucuucaagaucgagaaggggaagaucaccaagucgaucgagcuggacgcccccaacucccacuacgaggagugcagcugcuaccccgacgccggcacggugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcggccccgugaccgucgacggggcggacggcgugaagggcuucuccuaccgguacgggaacggcguguggaucgggcgcaccaagucgaacuccagccggcgcggcuucgagaugaucugggaccccaacggguggaccgacacggacuccaaguuccuggucaagcaggacgugguggccaugaccgacuggucgggcuacagcggcuccuucguccagcacccggagcugaccgggcucgacugcaugcggcccugcuucuggguggagcugauccgcggccggccccgcgagaacaccacgaucuggaccucgggguccagcaucuccuucugcggcgucaacggcgacaccgccaacuggagcuggcccgacggggccgagcugccguucaccaucgacaaguga

SEQ ID NO: 18227 - RNA, 1410 nt, Artificial Sequence; identical to SEQ ID NO: 16748
  derived and/or modified CDS sequence (AUadapt) from InfluenzaA__ABQ44430__NA

SEQ ID NO: 18228 - RNA, 1410 nt, Artificial Sequence; identical to SEQ ID NO: 18178
  derived and/or modified CDS sequence (AUadapt) from InfluenzaA__ABQ44441__NA

SEQ ID NO: 18229 - RNA, 1410 nt, Artificial Sequence; identical to SEQ ID NO: 18162
  derived and/or modified CDS sequence (AUadapt) from InfluenzaA__ABQ44463__NA

SEQ ID NO: 18230 - RNA, 1413 nt, Artificial Sequence
  derived and/or modified CDS sequence (AUadapt) from InfluenzaA__ABQ44474__NA
augaaccccaaccagaagaucaucaccaucggcucgaucugcaugaccaucgggacgaucucccugauccuccagaucggcaacaucaucagcaucugggugucccacucgauccagaccgggucccagaaccacaccggcaucugcaaccagcgcaucaucaccuacgagaacaacacgugggucaaccagaccuacgugaacaucagcaacaccaacguggucgccgggaaggacaccacguccaugauccuggccggcaacucgucccugugcccgauccggggcugggcgaucuacagcaaggacaacuccauccgcaucgggagcaagggcgacguguucgugauccgggagcccuucaucuccugcucgcaccucgagugccgcaccuucuuccugacccagggggcccugcucaacgacaagcacuccaacggcaccgucaaggaccggagccccuaccgcgcccugauguccugccccaucggggaggccccgucgcccuacaacucccgguucgagagcguggccuggucggcguccgccugccacgacggcaugggcuggcugacgaucgggaucagcggccccgacgacggggccguggccguccucaaguacaacggcaucaucaccgagaucaucaaguccuggcgcaagcagauccugcggacccaggagagcgagugcgugugcgugaacggcuccugcuucaccaucaugacggacgggcccucggacggcccggcguccuaccgcaucuucaagaucgagaaggggaagaucaccaagagcaucgagcuggacgcccccaacucccacuacgaggagugcucgugcuaccccgacaccggcaaggucaugugcgugugccgggacaacuggcacggguccaaccgccccugggugagcuucaaccagaaccucgacuaccagaucggcuacaucugcuccggcgucuucggggacaacccgcggcccaaggacggcaaggggucgugcgaccccgugaacguggacggcgccgacggggucaagggcuucuccuaccgcuacggcaacgggguguggaucggccggaccaagagcaacuccagccgcaagggguucgagaugaucugggaccccaacggcuggacggacaccgacgggaacuuccuggugaagcaggacgucguggccaugaccgacugguccggcuacucgggcagcuucgugcagcacccggagcugaccgggcucgacugcaugcggcccugcuucugggucgagcugauccgcggccggccccgcgagaagacgaccaucuggaccuccgggucguccaucagcuucugcggcgugaacuccgacaccgucaacuggagcuggcccgacggcgccgagcugccguucacgaucgacaaguga

SEQ ID NO: 18231 - RNA, 1410 nt, Artificial Sequence; identical to SEQ ID NO: 16337
  derived and/or modified CDS sequence (AUadapt) from InfluenzaA__ABR15800__NA

SEQ ID NO: 18232 - RNA, 1413 nt, Artificial Sequence; identical to SEQ ID NO: 18218
  derived and/or modified CDS sequence (AUadapt) from InfluenzaA__ABR15811__NA

SEQ ID NO: 18233 - RNA, 1413 nt, Artificial Sequence; identical to SEQ ID NO: 17230
  derived and/or modified CDS sequence (AUadapt) from InfluenzaA__ABR15910__NA

SEQ ID NO: 18234 - RNA, 1410 nt, Artificial Sequence; identical to SEQ ID NO: 16556
  derived and/or modified CDS sequence (AUadapt) from InfluenzaA__ABR15932__NA

SEQ ID NO: 18235 - RNA, 1410 nt, Artificial Sequence
  derived and/or modified CDS sequence (AUadapt) from InfluenzaA__ABR15943__NA
augaaccccaaccagaagaucaucaccaucggcucggugucccugaccaucgccacgaucugcuuccucaugcagaucgccauccuggucaccaccgugacccugcacuuccgccaguacgagugcaacucgccgcccaacaaccaggugaugcucugcgagcccacgaucaucgagcggaacaucaccgagaucgucuaccugaccaacaccacgaucgagaaggagaucugccccaagcuggcggaguaccgcaacugguccaagccgcagugcaacaucaccggguucgcccccuucagcaaggacaacuccauccggcucucggccggcggggacaucugggugacccgcgagcccuacguguccugcgaccccgacaagugcuaccaguucgcccugggccaggggaccacgcugaacaacggccacagcaacgacaccguccacgaccggaccccguaccgcacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcgggcacggggucaagggcugggccuucgacgacggcaacgacguguggauggggcggaccaucucggagaagcugcgcuccggcuacgagaccuucaaggucaucgagggguggucgaagcccaacuccaagcuccagaccaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggacguacggcaccgggagcuggccggacggcgccgacaucaaccugaugcccaucuga

SEQ ID NO: 18236 - RNA, 1410 nt, Artificial Sequence
  derived and/or modified CDS sequence (AUadapt) from InfluenzaA__ABR15954__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacaacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaccaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 18237 - RNA, 1410 nt, Artificial Sequence; identical to SEQ ID NO: 16556
  derived and/or modified CDS sequence (AUadapt) from InfluenzaA__ABR15965__NA

SEQ ID NO: 18238 - RNA, 1410 nt, Artificial Sequence
  derived and/or modified CDS sequence (AUadapt) from InfluenzaA__ABR22243__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgucgccccugagcggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaccgacucguccagcuccucgcacugccuggaccccaacaacgaggagggcgggcacggggucaagggcugggccuucgacgacggcaacgacguguggauggggcggaccaucuccgagaagucccgcucgggcuacgagaccuucaaggucaucgagggguggagcaagccgaacuccaagcugcagaucaaccgccaggugaucguggaccggggcaaccggucgggguacuccggcaucuucucggucgagggcaagagcugcaucaaccgcugcuucuacguggagcucauccgggggcgcaagcaggagaccgaggugcuguggaccuccaacucgaucgucguguucugcggcaccuccgggacguacggcaccgggagcuggcccgacggcgccgaccugaaccucaugcccaucuga

SEQ ID NO: 18239 - RNA, 1410 nt, Artificial Sequence; identical to SEQ ID NO: 17132
  derived and/or modified CDS sequence (AUadapt) from InfluenzaA__ABR28518__NA

SEQ ID NO: 18240 - RNA, 1410 nt, Artificial Sequence; identical to SEQ ID NO: 16978
  derived and/or modified CDS sequence (AUadapt) from InfluenzaA__ABR28595__NA

SEQ ID NO: 18241 - RNA, 1413 nt, Artificial Sequence
  derived and/or modified CDS sequence (AUadapt) from InfluenzaA__ABR28771__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagccgcgagcucaacgcccccaacuuccacuacgaggagugcuccugcuacccggacaccggcaccgugaugugcgugugccgggacaacuggcacgggucgaaccgccccugggucuccuucaaccagaaccuggacuaccagaucggcuacaucugcagcggcguguucggggacaacccccggcccaaggacggcgagggguccugcaacccggugacggucgacggcgcggacggggugaagggcuucucguacaaguacggcaacgggguguggaucggccgcaccaaguccaaccggcugcgcaagggguucgagaugaucugggaccccaacggcuggaccgacaccgacagcaacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 18242 - RNA, 1413 nt, Artificial Sequence
  derived and/or modified CDS sequence (AUadapt) from InfluenzaA__ABR28782__NA
augaaccccaaccagaagaucaucaccaucggcucgaucuccaucgccaucgggauccugagccucaugcugcagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccucugcuccaucagcggcugggccaucuacaccaaggacaacuccauccggaucgggucgaagggcgacguguucgugauccgcgagccguucaucuccugcagccaccuggagugccggacguucuuccugacccagggggcccuccugaacgacaagcacuccaacggcaccgucaaggaccgcucgcccuaccgggcccugauguccugcccccucggggaggcgcccagcccguacaacucgaaguucgaguccguggccuggagcgccuccgccugccacgacggcaugggcuggcugaccaucgggaucagcggccccgacaacggggcgguggccguccugaaguacaacggcaucaucacggagaccaucaaguccuggaagaagcgcauccuccggacccaggagucggagugcgugugcgugaacggcuccugcuucaccaucaugacggacgggcccagcaacggcgccgccuccuacaagaucuucaagaucgagaaggggaaggucaccaagucgaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacagcaacuucuccgucaagcaggacgugguggccaucacggacuggucgggguacagcggcuccuucguccagcaccccgagcugaccggccuggacugcauccgccccugcuucuggguggagcucguccgggggcugccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 18243 - RNA, 1410 nt, Artificial Sequence; identical to SEQ ID NO: 17246
  derived and/or modified CDS sequence (AUadapt) from InfluenzaA__ABR28793__NA

SEQ ID NO: 18244 - RNA, 1413 nt, Artificial Sequence; identical to SEQ ID NO: 17230
  derived and/or modified CDS sequence (AUadapt) from InfluenzaA__ABR28804__NA

SEQ ID NO: 18245 - RNA, 1410 nt, Artificial Sequence; identical to SEQ ID NO: 17132
  derived and/or modified CDS sequence (AUadapt) from InfluenzaA__ABR28815__NA

SEQ ID NO: 18246 - RNA, 1410 nt, Artificial Sequence; identical to SEQ ID NO: 16556
  derived and/or modified CDS sequence (AUadapt) from InfluenzaA__ABR28826__NA

SEQ ID NO: 18247 - RNA, 1413 nt, Artificial Sequence; identical to SEQ ID NO: 16798
  derived and/or modified CDS sequence (AUadapt) from InfluenzaA__ABR28837__NA

SEQ ID NO: 18248 - RNA, 1413 nt, Artificial Sequence
  derived and/or modified CDS sequence (AUadapt) from InfluenzaA__ABR28848__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgucgggaaggacaagaccagcgugacccuggcgggcaacuccucgcugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcagccccuaccgggcccugauguccugcccccugggggaggcccccucgccguacaacagcaaguucgaguccguggcguggagcgccuccgccugccacgacggcaugggcuggcucaccaucgggaucucgggccccgacaacggggccgucgcggugcugaaguacaacggcaucaucacggagaccaucaaguccuggaagaagcagauccugcgcacccaggagagcgagugcgugugcgucaacggcuccugcuucaccaucaugacggacgggcccucgaacggcgccgccuccuacaagaucuucaagaucgagaaggggaagaucaccaagagcaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcgagggguccugcaacccggugacggucgacggcgccaacggggugaagggcuucagcuacaaguacggcaacgggguguggaucggccgcaccaaguccaaccggcugcgcaagggguucgagauggucugggaccccaacggcuggaccgacaccgacucggacuucuccgugaagcaggacguggucgcgaucacggacuggagcggguacagcggcuccuucgugcagcaccccgagcucaccggccugaacugcauccggcccugcuucugggucgagcuggugcgcgggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 18249 - RNA, 1410 nt, Artificial Sequence
  derived and/or modified CDS sequence (AUadapt) from InfluenzaA__ABR28859__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacggccgcaccccguaccggacccuccugaugaacgagcugggggugcccuuccaccucggcacgcgccaggugugcaucgccugguccucguccagcugccacgacgggaaggcguggcugcacgucugcgugaccggcgacgacgagaacgccaccgccuccuucaucuacaacgggcggcugguggacucgaucggcuccuggagcaagaagauccuccgcacccaggaguccgagugcgucugcaucaacggcacgugcaccguggugaugaccgacgggucggccuccggcaaggcggacaccaagauccuguucaucgaggaggggaagaucguccacaucagcacgcugucgggcuccgcccagcacguggaggagugcucgugcuacccccgguaccccggcgugcgcugcgucugccgggacaacuggaagggguccaaccgcccgaucguggacaucaacgugaaggacuacagcaucgucuccucguacgugugcuccggccucgugggggacacgccccggaagaacgacagcuucuccucgucccacugccuggaccccaacaacgaggagggcgggcacggcgucaagggcugggccuucgacgacgggaacgacguguggaugggccgcaccaucagcgagaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggaccagcaacucgaucgucguguucugcgggaccuccggcaccuacgggacgggcagcuggccggacggcgccgacaucaaccugaugcccaucuga

SEQ ID NO: 18250 - RNA, 1410 nt, Artificial Sequence
  derived and/or modified CDS sequence (AUadapt) from InfluenzaA__ABR28870__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaccgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacgcaggaguccgagugcgucugcaucaacgggaccugcaccguggugaugaccgacggcagcgccuccgggaaggcggacacgaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 18251 - RNA, 1410 nt, Artificial Sequence
  derived and/or modified CDS sequence (AUadapt) from InfluenzaA__ABR28881__NA
augaaccccaaccagaagaucaucaccaucggcucggugucccugaccaucgccacggucugcuuccucaugcagaucgccauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccucgugccacgacggcaaggcguggcugcacgugugcgugaccggggacgacgagaacgccaccgccuccuucaucuacaacggccggcuggucgacagcaucggguccuggucgaagaagauccuccgcacccaggaguccgagugcgugugcaucaacggcacgugcaccguggucaugaccgacggcagcgccuccgggaaggcggacaccaagauccuguucaucgaggagggcaagaucgugcacaucucgacgcugagcggguccgcccagcacguggaggagugcucgugcuacccccgguaccccggcguccgcugcgugugccgggacaacuggaagggcuccaaccgcccgaucguggacaucaacgucaaggacuacucgaucguguccagcuacgugugcuccgggcucgucggcgacacgccccggaagaacgacucguucuccagcucccacugccuggaccccaacaacgaggagggcgggcacggggugaagggcugggccuucgacgacggcaacgacgucuggauggggcgcaccaucucggagaagcugcgguccggcuacgagaccuucaaggugaucgagggguggucgaagcccaacuccaagcuccagaccaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggacguacggcaccgggagcuggccggacggcgccgacaucaaccugaugcccaucuga

SEQ ID NO: 18252 - RNA, 1410 nt, Artificial Sequence; identical to SEQ ID NO: 17116
  derived and/or modified CDS sequence (AUadapt) from InfluenzaA__ABR28892__NA

SEQ ID NO: 18253 - RNA, 1413 nt, Artificial Sequence; identical to SEQ ID NO: 16788
  derived and/or modified CDS sequence (AUadapt) from InfluenzaA__ABR28903__NA

SEQ ID NO: 18254 - RNA, 1410 nt, Artificial Sequence
  derived and/or modified CDS sequence (AUadapt) from InfluenzaA__ABR28925__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggaggugcugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 18255 - RNA, 1410 nt, Artificial Sequence
  derived and/or modified CDS sequence (AUadapt) from InfluenzaA__ABR88082__NA
auggaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaucaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccgucgugagcugguccaaggacauccugcggacccaggagucggagugcgugugcaucaacggcacgugcaccgucgugaugaccgacggguccgccagcggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaagaacuacuccaucgugucguccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 18256 - RNA, 1413 nt, Artificial Sequence
  derived and/or modified CDS sequence (AUadapt) from InfluenzaA__ABS00324__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccguggcgcuggccggcaacucgucccugugcccgaucagcggcugggccaucuacuccaaggacaacagcauccggaucggguccaagggcgacguguucgucauccgcgagcccuucaucucgugcucccaccucgagugccggaccuucuuccugacgcagggggcccugcucaacgacaagcacagcaacggcaccgugaaggaccgcucccccuaccgggcccugaugucgugccccaucggggaggcgccgucccccuacaacagccgcuucgagagcguggccugguccgccucggccugccacgacggcaugggcuggcugaccaucgggaucuccggccccgacgacggggcggucgccgugcucaaguacaacggcaucaucaccgagacgaucaagagcuggcggaagcgcauccugcggacccaggaguccgagugcgugugcgucaacggcucgugcuucaccaucaugaccgacgggcccaacaacggcccggccuccuacaagaucuucaagaucgagaaggggaagaucaccaagagcaucgagcuggacgcccccaacucccacuacgaggagugcagcugcuaccccgacgccggcacggugaugugcgugugccgcgacaacuggcggggguccaaccgccccugggucucguucaaccagucccucgacuaccagaucggcuacaucugcagcggcguguucggggacaacccgcggcccaaggacggcaagggguccugcgaccccgugaccgucgacggcgcggacggggugaagggcuucucguaccgcuacggcaacgggguguggaucggccggaccaaguccaacagcucccgccggggguucgagaugaucugggaccccaacggcuggacggacaccgacagcaaguuccuggucaagcaggacgugguggccaugaccgacuggucgggguacuccggcagcuucguccagcacccggagcugaccggccucgacugcaugcgccccugcuucuggguggagcugauccgggggcgcccccgggagaacacgaccaucuggaccuccggcucguccaucagcuucugcggggucaacggcgacaccgccaacugguccuggcccgacggcagcgagcugccguucacgaucgacaaguga

SEQ ID NO: 18257 - RNA, 1410 nt, Artificial Sequence; identical to SEQ ID NO: 16516
  derived and/or modified CDS sequence (AUadapt) from InfluenzaA__ABS49902__NA

SEQ ID NO: 18258 - RNA, 1410 nt, Artificial Sequence
  derived and/or modified CDS sequence (AUadapt) from InfluenzaA__ABS49913__NA
augaaccccaaccagaagaucaucaccaucggcucggugucccugaccaucgccacggucugcuuccucaugcagaucgccauccuggugaccaccgugacccugcacuuccgccaguacgagugcgacucgccgacgaacaaccaggucaugcccugcgagcccaucaucaucgagcggaacaucaccgagaucguguaccucaacaacaccaccaucgagaaggagaucugccccaagcugguggaguaccgcaacugguccaagccgcagugcaagaucacgggguucgcgcccuucagcaaggacaacuccauccggcugucggccggcggggacaucugggucacccgcgagcccuacguguccugcgaccccggcaagugcuaccaguucgcccucgggcagggcaccacccuggacaacaagcacucgaacgacacgauccacgaccggaucccgcaccgcacccugcucaugaacgagcugggcgugcccuuccaccuggggacccggcaggucugcaucgccugguccagcuccucgugccacgacggcaaggccuggcuccacgugugcgugaccggggacgacaagaacgcgacggccuccuucaucuacgacggccgccuggucgacucgaucggguccuggagccagaacauccugcggacccaggaguccgagugcgugugcaucaacgggaccugcaccguggucaugacggacggcucggccuccggccgcgccgacacccggauccucuucaucgaggagggcaagaucgugcacaucucgccccugagcggguccgcgcagcacguggaggagugcucgugcuacccccgcuacccgggcguccggugcaucugccgcgacaacuggaagggcuccaaccggcccgugguggacaucaacgucgaggacuacucgaucgacuccagcuacgugugcuccgggcuggugggcgacacgccccgcaacaacgaccggucguccaacucgaacugccgcaaccccaacaacgagcgggggaaccacggcgucaaggggugggccuucgacgacggcaacgacguguggaugggccgcaccaucuccaaggaccuccggagcggguacgagaccuucaaggucaucggcgggugguccaccccgaacucgaagucccagaucaaccgccaggugaucguggacucggacaaccgcuccggcuacagcgggaucuucuccgucgagggcaagucgugcaucaaccggugcuucuacguggagcugauccgcggccgggagcaggagacccgcgugugguggaccucgaacuccaucgucguguucugcgggacgagcggcaccuacgggaccggcuccuggcccgacggggccgacaucaaccugaugcccaucuga

SEQ ID NO: 18259 - RNA, 1410 nt, Artificial Sequence; identical to SEQ ID NO: 17246
  derived and/or modified CDS sequence (AUadapt) from InfluenzaA__ABS49968__NA

SEQ ID NO: 18260 - RNA, 1413 nt, Artificial Sequence; identical to SEQ ID NO: 18242
  derived and/or modified CDS sequence (AUadapt) from InfluenzaA__ABS49979__NA

SEQ ID NO: 18261 - RNA, 1413 nt, Artificial Sequence
  derived and/or modified CDS sequence (AUadapt) from InfluenzaA__ABS49990__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucauccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccucgaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacucgaacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccucgggcuccagcaucuccuucugcggggugaacagcgacacggccaacugguccuggcccgacggcgccgagcugcccuucaccaucgacaaguga

SEQ ID NO: 18262 - RNA, 1410 nt, Artificial Sequence; identical to SEQ ID NO: 17132
  derived and/or modified CDS sequence (AUadapt) from InfluenzaA__ABS50001__NA

SEQ ID NO: 18263 - RNA, 1410 nt, Artificial Sequence; identical to SEQ ID NO: 17132
  derived and/or modified CDS sequence (AUadapt) from InfluenzaA__ABS50012__NA

SEQ ID NO: 18264 - RNA, 1410 nt, Artificial Sequence
  derived and/or modified CDS sequence (AUadapt) from InfluenzaA__ABS50023__NA
augaaccccaaccagaagaucaucaccaucggcucggugucccugaccaucgccacgaucugcuuccucaugcagaucgccguccuggugaccaccgugacccugcacuucaagcaguacgagugcaacccgccgcccaacaaccaggucaugcucugcgagcccacgaucaucgagcgcaacaucaccgagaucguguaccugaccaacaccacgaucgagaaggagaucugccccaagcuggcggaguaccggaacuggucgaagccccagugcaacaucaccggguucgcccccuucuccaaggacaacagcauccgccucuccgccggcggggacaucugggugacccgggagcccuacgucucgugcgacccggacaagugcuaccaguucgcccugggccaggggaccacgcugaacaacggccacuccaacgacaucgugcacgaccgcacccccuaccggacccuccugaugaacgagcugggcgugcccuuccaccucgggaccaagcaggucugcaucgccuggagcuccucguccugccacgacggcaaggcguggcugcacgugugcgugacgggggacgacgagaacgccaccgccucguucaucuacaacggccgccuggucgacuccaucgggagcugguccaagaagauccuccggacccaggagucggagugcgugugcaucaacgggaccugcacgguggucaugaccgacggcuccgccagcgggaaggcggacaccaagauccuguucaucgaggagggcaagaucgugcacaccucccugcucucggggagcgcccagcacguggaggagugcuccugcuacccccgcuacccgggcguccggugcgugugccgcgacaacuggaagggcucgaaccggcccaucguggacaucaacgucaaggacuacuccaucgugucguccuacgugugcagcgggcuggucggcgacacgccccgcaagaacgacuccucguccagcucccacugccuggaccccaacaacgaggagggcggccacggggugaagggcugggccuucgacgacggcaacgacgucuggauggggcggaccaucucggagaagcuccgcuccggcuacgagaccuucaaggugaucgagggguggucgaagccgaacuccaagcugcagaucaaccgccaggugaucgucgaccggggcaaccggagcggguacuccggcaucuucucgguggagggcaaguccugcaucaaccgcugcuucuacguggagcugauccgggggcgcaagcaggagaccgagguccucuggacgagcaacucgaucgugguguucugcggcaccuccgggaccuacggcaccgggagcuggcccgacggcgccgacaucaaccugaugcccaucuga

SEQ ID NO: 18265 - RNA, 1410 nt, Artificial Sequence; identical to SEQ ID NO: 17132
  derived and/or modified CDS sequence (AUadapt) from InfluenzaA__ABS50034__NA

SEQ ID NO: 18266 - RNA, 1410 nt, Artificial Sequence
  derived and/or modified CDS sequence (AUadapt) from InfluenzaA__ABS50045__NA
augaaccccaaccagaagaucaucaccaucggcucggugucccugaccaucgccacgaucugcuuccucaugcagaccgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccauccacgaccgcaccccguaccggacgcuccugaugaacgagcugggcguccccuuccaccucgggacccgccaggugugcaucgccugguccucguccucgugccacgacggcaaggcguggcugcacgugugcgucaccggggacgacgagaacgccaccgccuccuucaucuacaacggccggcugguggacagcaucggguccuggucgaagaagauccuccgcacgcaggaguccgagugcgugugcaucaacgggaccugcaccgucgugaugaccgacggcagcgccuccgggaaggcggacacgaagauccuguucaucgaggagggcaagaucgugcacaucucgacccugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcggccacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggacguacggcaccgggagcuggccggacggcgccgacaucaaccugaugcccaucuga

SEQ ID NO: 18267 - RNA, 1410 nt, Artificial Sequence; identical to SEQ ID NO: 16556
  derived and/or modified CDS sequence (AUadapt) from InfluenzaA__ABS50056__NA

SEQ ID NO: 18268 - RNA, 1410 nt, Artificial Sequence; identical to SEQ ID NO: 16582
  derived and/or modified CDS sequence (AUadapt) from InfluenzaA__ABS50067__NA

SEQ ID NO: 18269 - RNA, 1410 nt, Artificial Sequence; identical to SEQ ID NO: 17116
  derived and/or modified CDS sequence (AUadapt) from InfluenzaA__ABS50078__NA

SEQ ID NO: 18270 - RNA, 1413 nt, Artificial Sequence
  derived and/or modified CDS sequence (AUadapt) from InfluenzaA__ABS71644__NA
augaagcccaaccagaagaucaucaccaucggcucgaucuccaucgccaucgggaucaucagccugauccuccagaucggcaacaucaucuccaucugggccucgcacuccauccagaccgagagccagaaccacacggggaucugcaaccagcgcaucaucaccuacgagaacuccaccugggugaacaacaccuacgucaacaucaacaacacgaacgugguggcggagaaggacaagaccucggucacccuggccggcaacuccagccugugcuccaucucggggugggccaucuacaccaaggacaacuccauccggaucggcagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagccgcuucgaguccguggccuggagcgccuccgccugccacgacggcaugggguggcucaccaucggcaucucgggccccgacaacggggcgguggccguccugaaguacaacggcaucaucacggagaccaucaaguccuggaagaagcggauccugcgcacccaggagagcgagugcgugugcaugaacggguccugcuucaccaucaugacggacggccccucgaacggcgccgccuccuacaagaucuucaagaucgagaaggggaaggugaccaagaccauggagcucaacgcccccaacuuccacuacgaggagugcagcugcuacccggacaccggcacggucaugugcgugugccgggacaacuggcacggguccaaccgccccugggugucguucaaccagaaccuggacuaccagaucggcuacaucugcuccggggucuucggcgacaacccccggcccaaggacggcgaggggagcugcaacccggugaccguggacggcgcggacggggucaagggcuucuccuacaaguacgggaacggcguguggaugggccgcaccaagucgaaccggcugcgcaagggguucgagaugaucugggaccccaacggcuggaccaacacggacuccgacuucagcgugaagcaggacgucguggccaucaccgacugguccggguacucgggcagcuucgugcagcaccccgagcucaccgggcuggacugcauccggcccugcuucugggucgagcuggugcgcggccucccgcgggagaacaccacgaucuggaccuccggcucguccaucagcuucugcggggucaacuccggcaccgccaacuggagcuggcccgacggggccgagcugcccuucaccaucgacaaguga

SEQ ID NO: 18271 - RNA, 1413 nt, Artificial Sequence
  derived and/or modified CDS sequence (AUadapt) from InfluenzaA__ABS71646__NA
augaaccccaaccagaagaucaucaccaucggcucgaucuccaucgccaucgggaucaucagccugauccuccagaucggcaacaucaucuccaucugggccucgcacuccauccagaccgagagccagaaccacacggggaucugcaaccagcgcaucaucaccuacgagaacuccaccugggugaacaacaccuacgucaacaucaacaacacgaacgugguggcggagaaggacaagaccucggucacccuggccggcaacuccagccugugcuccaucucggggugggccaucuacaccaaggacaacuccauccggaucggcagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagccgcuucgaguccguggccuggagcgccuccgccugccacgacggcaugggguggcucaccaucggcaucucgggccccgacaacggggcgguggccguccugaaguacaacggcaucaucacggagaccaucaaguccuggaagaagcggauccugcgcacccaggagagcgagugcgugugcaugaacggguccugcuucaccaucaugacggacggccccucgaacggcgccgccuccuacaagaucuucaagaucgagaaggggaaggugaccaagaccauggagcucaacgcccccaacuuccacuacgaggagugcagcugcuacccggacaccggcacggucaugugcgugugccgggacaacuggcacggguccaaccgccccugggugucguucaaccagaaccuggacuaccagaucggcuacaucugcuccggggucuucggcgacaacccccggcccaaggacggcgaggggagcugcaacccggugaccguggacggcgcggacggggucaagggcuucuccuacaaguacgggaacggcguguggaugggccgcaccaagucgaaccggcugcgcaagggguucgagaugaucugggaccccaacggcuggaccaacacggacuccgacuucagcgugaagcaggacgucguggccaucaccgacugguccggguacucgggcagcuucgugcagcaccccgagcucaccgggcuggacugcauccggcccugcuucugggucgagcuggugcgcggccucccgcgggagaacaccacgaucuggaccuccggcucguccaucagcuucugcggggucaacuccggcaccgccaacuggagcuggcccgacggggccgagcugcccuucaccaucgacaaguga

SEQ ID NO: 18272 - RNA, 1413 nt, Artificial Sequence
  derived and/or modified CDS sequence (AUadapt) from InfluenzaA__ABS71647__NA
augaaccccaaccagaagaucaucaccaucggcucgaucuccaucgccaucgggaucaucagccugauccuccagaucggcaacaucaucuccaucugggccucgcacuccauccagaccgagagccagaaccacacggggaucugcaaccagcgcaucaucaccuacgagaacuccaccugggugaacaacaccuacgucaacaucaacaacacgaacgugguggcggagaaggacaagaccucggucacccuggccggcaacuccagccugugcuccaucucggggugggccaucuacaccaaggacaacuccauccggaucggcagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagccgcuucgaguccguggccuggagcgccuccgccugccacgacggcaugggguggcucaccaucggcaucucgggccccgacaacggggcgguggccguccugaaguacaacggcaucaucacggagaccaucaaguccuggcggaagcgcauccugcggacccaggagagcgagugcgugugcaugaacggguccugcuucaccaucaugacggacggccccucgaacggcgccgccuccuacaagaucuucaagaucgagaaggggaaggugaccaagaccauggagcucaacgcccccaacuuccacuacgaggagugcagcugcuacccggacaccggcacggucaugugcgugugccgcgacaacuggcacggguccaaccggcccugggugucguucaaccagaaccuggacuaccagaucggcuacaucugcuccggggucuucggcgacaacccccgccccaaggacggcgaggggagcugcaacccggugaccguggacggcgcggacggggucaagggcuucuccuacaaguacgggaacggcguguggaugggccggaccaagucgaaccgccugcggaagggguucgagaugaucugggaccccaacggcuggaccaacacggacuccgacuucagcgugaagcaggacgucguggccaucaccgacugguccggguacucgggcagcuucgugcagcaccccgagcucaccgggcuggacugcauccgccccugcuucugggucgagcuggugcggggccucccgcgcgagaacaccacgaucuggaccuccggcucguccaucagcuucugcggggucaacuccggcgccgccaacuggagcuggcccgacggggccgagcugcccuucaccaucgacaaguga

SEQ ID NO: 18273 - RNA, 1413 nt, Artificial Sequence
  derived and/or modified CDS sequence (AUadapt) from InfluenzaA__ABS71648__NA
augaaccccaaccagaagaucaucaccaucggcucgaucuccaucgccaucgggaucaucagccugauccuccagaucggcaacaucaucuccaucugggccucgcacuccauccagaccgggaaccagaaccacacgggcaucugcaaccagcgcaucaucaccuacgagaacagcaccugggugaacaacaccuacgucaacaucaacaacacgaacgugguggcggagaaggacaagaccuccgucacccuggccgggaacucgucccugugcagcaucuccggcugggccaucuacaccaaggacaacucgauccggaucggcuccaagggggacguguucgugauccgcgagccguucaucagcugcucccaccucgagugccggacguucuuccugacccagggcgcccugcucaacgacaagcacucgaacgggaccgucaaggaccgcucccccuaccgggcccugaugagcugcccccugggcgaggcgcccuccccguacaacucgcgcuucgagagcguggccugguccgccucggccugccacgacgggaugggcuggcucaccaucggcaucuccgggcccgacaacggcgcgguggccguccugaaguacaacgggaucaucacggagaccaucaagagcuggaagaagcggauccugcgcacccaggaguccgagugcgugugcaugaacggcucgugcuucaccaucaugacggacggccccuccaacggggccgccagcuacaagaucuucaagaucgagaagggcaaggugaccaagaccaucgagcucaacgcccccaacuuccacuacgaggagugcuccugcuacccggacaccgggacggucaugugcgugugccgggacaacuggcacggcucgaaccgccccuggguguccuucaaccagaaccuggacuaccagaucggguacaucugcagcggcgucuucggcgacaacccccggcccaaggacggggagggcuccugcaacccggugaccguggacggggcggacggcgucaagggguucucguacaaguacggcaacggcguguggaucgggcgcaccaaguccaaccggcugcgcaagggcuucgagaugaucugggaccccaacggguggaccaacacggacagcgacuucuccgugaagcaggacgucguggccaucaccgacuggucgggcuacuccgggagcuucgugcagcaccccgagcucaccggccuggacugcauccggcccugcuucugggucgagcuggugcgcggccucccgaaggagaacaccacgaucuggaccucgggguccagcaucuccuucugcggcgucaacagcgggaccgccaacugguccuggcccgacggcgccgagcugcccuucaccaucgacaaguga

SEQ ID NO: 18274 - RNA, 1413 nt, Artificial Sequence
  derived and/or modified CDS sequence (AUadapt) from InfluenzaA__ABS71649__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggagaaggacaagaccagcgucacccuggccgggaacuccucgcugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcagccccuaccgggcccugauguccugcccccugggcgaggcgcccucgccguacaacagcaaguucgaguccguggccuggagcgccuccgccugccacgacgggaugggcuggcucaccaucggcaucucggggcccgacaacggcgcgguggccguccugaaguacaacgggaucaucacgggcaccaucaaguccuggaagaagcagauccugcgcacccaggagagcgagugcgugugcaugaacggcuccugcuucaccaucaugacggacgggcccucgaaccgggccgccuccuacaagaucuucaagaucgagaagggcaaggugaccaagagcaucgagcucaacgcccccaacuuccacuacgaggagugcuccugcuacccggacaccgggaucgucaugugcgugugccgcgacaacuggcacggcagcaaccggcccuggguguccuucaaccagaaccuggacuaccagaucggguacaucugcucgggcgucuucggcgacaacccccgccccaaggacggggagggcuccugcaacccggugaccguggacggggcggacggcgucaagggguucagcuacaaguacgacaacggcguguggaucggccggacgaaguccaaccgccugcggaagggguucgagaugaucugggaccccaacggcuggaccaacaccgacucggacuucuccgugaagcaggacgucguggccaucaccgacuggagcggguacagcggcuccuucgugcagcaccccgagcucacggggcuggacugcauccgccccugcuucugggucgagcuggugcggggccucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 18275 - RNA, 1413 nt, Artificial Sequence
  derived and/or modified CDS sequence (AUadapt) from InfluenzaA__ABS71651__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacucgucccugugcagcguguccggcugggccaucuacaccaaggacaacagcauccggaucggguccaagggcgacguguucgucauccgcgagccguucaucucgugcucccaccucgagugccggacguucuuccugacccagggggcccugcucaacgacaagcacagcaacggcaccgugaaggaccgcucccccuaccgggcccugaugucgugcccccugggggaggcgcccuccccguacaacagcaaguucgagucgguggccugguccgccagcgccugccacgacggcaugggcuggcucaccaucgggaucuccggccccgacaacggggcggucgccgugcugaaguacaacggcaucaucacgggcaccaucaagagcuggaagaagcgcauccugcggacccaggaguccgagugcgugugcaugaacgggucgugcuucaccaucaugacggacggccccuccaacggggccgccagcuacaagaucuucaagaucgagaagggcaaggucaccaaguccaucgagcucaacgcccccucguuccacuacgaggagugcuccugcuacccggacaccgggaccgugaugugcgugugccgcgacaacuggcacggcagcaaccggcccugggucuccuucaaccagaaccuggacuaccagaucggcuacaucugcucggggguguucggcgacaacccccgccccaaggacggggagggcuccugcaacccggugacggucgacggggcggacggcgugaagggcuucagcuacaaguacgggaacggcguguggcuggggcggaccaaguccaaccgccuccggaagggcuucgagaugaucugggaccccaacggguggaccaacaccgacagcgacuucuccgucaagcaggacgugguggccaucacggacuggucgggcuacagcggcuccuucguccagcaccccgagcugaccgggcuggacugcauccgccccugcuucuggguggagcucguccggggccugccgcgcgagaacaccaccaucuggacgucgggguccagcaucuccuucugcggcgugaacagcaacaccgccaacugguccuggcccgacggcgccgagcugcccuucaccaucgacaaguga

SEQ ID NO: 18276 - RNA, 1413 nt, Artificial Sequence
  derived and/or modified CDS sequence (AUadapt) from InfluenzaA__ABS71652__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacaacaccugggugaaccacaccuacgucaacaucaacaacacgaacgugguggcggggaaggacaagaccuccgucacccuggccggcaacucgucccugugcagcguguccggcugggccaucuacaccaaggacaacagcauccggaucggguccaagggcgacguguucgucauccgcgagccguucaucucgugcucccaccucgagugccggacguucuuccugacccagggggcccugcucaacgacaagcacagcaacggcaccgugaaggaccgcucccccuaccgggcccugaugucgugcccccugggggaggcgcccuccccguacaacagcaaguucgagucgguggccugguccgccagcgccugccacgacggcaugggcuggcucaccaucgggaucuccggccccgacaacggggcggucgccgugcugaaguacaacggcaucaucacggagaccaucaagagcuggaagaagcgcauccugcggacccaggaguccgagugcgugugcaugaacggcucgugcuucaccaucaugacggacgggcccuccaacggcgccgccagcuacaagaucuucaagaucgagaaggggaaggucaccaaguccaucgagcucaacgcccccucguuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcaacaccgccaacugguccuggcccgacggcgccgagcugcccuucaccaucgacaaguga

SEQ ID NO: 18277 - RNA, 1413 nt, Artificial Sequence
  derived and/or modified CDS sequence (AUadapt) from InfluenzaA__ABS71653__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugaugaucugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccucguacaagaucuucaagaucgagaaggggaaggucaccaagucccgcgagcucaacgcccccaacuuccacuacgaggagugcagcugcuacccggacaucggcaccgugaugugcgugugccgggacaacuggcacggguccaaccgccccugggucucguucaaccagaaccuggacuaccagaucggcuacaucugcuccggcguguucggggacaacccccggcccaaggacggcaaggggagcugcaacccggugaccgcggacggcgccgacggggucaagggcuucuccuacaaguacggcaacgggguguggaucggccgcaccaagucgaaccggcugcgcaagggguucgagaugaucugggaccccaacggcuggacggacaccgacuccgacuucagcgugaagcaggacgucguggccaucaccgacugguccggguacucgggcagcuucgugcagcaccccgagcucacgggccuggacugcauccggcccugcuucugggucgagcuggugcgcgggcucccgcgggagaacaccaccaucuggaccuccggcucguccaucagcuucugcggggucgacuccgacacggccaacuggagcuggcccgacggcgccgagcugcccuucaccaucgacaaguga

SEQ ID NO: 18278 - RNA, 1410 nt, Artificial Sequence
  derived and/or modified CDS sequence (AUadapt) from InfluenzaA__ABS71655__NA
augaaccccaucaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18279 - RNA, 1410 nt, Artificial Sequence
  derived and/or modified CDS sequence (AUadapt) from InfluenzaA__ABS71657__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacucgaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgcuaccccggcguccggugcgugugccgcgacaacuggaagggguccaaccggccgaucguggacaucaacaucaaggacuacucgaucgucucccgcuacgugugcagcggccuggugggcgacacgccccggaagaacgacuccucguccagcucccacugccucgaccccaacaacgaggagggcgggcacggggucaagggcugggccuucgacgacgggaacgacgccuggaugggccgcaccaucucggagaagucccggagcggcuacgagaccuucaaggugaucgaggggugguccaaccccaacucgaagcugcagaucaaccgccaggucaucguggaccggggcaaccgcuccggguacagcggcaucuucucgguggaggggaaguccugcaucaaccggugcuucuacgucgagcugauccgcggccggaaggaggagaccgaggugcucuggaccagcaacuccaucguggucuucugcggcaccagcgggacguacggcaccggguccuggccggacggcgccgacaucaaccugaugcccaucuga

SEQ ID NO: 18280 - RNA, 1410 nt, Artificial Sequence
  derived and/or modified CDS sequence (AUadapt) from InfluenzaA__ABS71659__NA
augaaccccaucaagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacucgaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgcuaccccggcguccggugcgugugccgcgacaacuggaagggguccaaccggccgaucguggacaucaacaucaaggacuacucgaucgucucccgcuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucggcgagaagucccggucgggguacgagaccuucaaggucaucgagggcuggagcaaccccaacuccaagcugcagaucaaccgccaggugaucguggaccgggggaaccgcucgggcuacuccgggaucuucagcgucgagggcaagucgugcaucaaccggugcuucuacguggagcugauccgcggccggaaggaggagaccgaggugcucuggaccuccaacagcaucgucguguucugcgggaccuccggcacguacgggaccggcagcuggccggacggggccgacaucaaccacaugcccaucuga

SEQ ID NO: 18281 - RNA, 1410 nt, Artificial Sequence
  derived and/or modified CDS sequence (AUadapt) from InfluenzaA__ABS71660__NA
augaaccccaucaagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 18282 - RNA, 1410 nt, Artificial Sequence
  derived and/or modified CDS sequence (AUadapt) from InfluenzaA__ABS71661__NA
auguaccccaucaagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccagcugccacgacgggaaggccuggcuccacgugugcgugaccggcgacgacaagaacgcgaccgccuccuucaucuacaacgggcgccugguggacucgaucgucuccuggagcaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucucccgcuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucagcgagaagucccggucgggcuacgagaccuucaaggucaucgaggggugguccaaccccaacagcaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 18283 - RNA, 1410 nt, Artificial Sequence
  derived and/or modified CDS sequence (AUadapt) from InfluenzaA__ABS71662__NA
augaaccccaucaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaacuccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18284 - RNA, 1410 nt, Artificial Sequence
  derived and/or modified CDS sequence (AUadapt) from InfluenzaA__ABS71663__NA
auguaccccaucaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgaccagaacgcgaccgccucguucaucuacaacgggcggcugguggacuccaucgugagcugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggagcaaccccaacuccaagcugcagaugaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18285 - RNA, 1410 nt, Artificial Sequence
  derived and/or modified CDS sequence (AUadapt) from InfluenzaA__ABU40956__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaacugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucaucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 18286 - RNA, 1410 nt, Artificial Sequence
  derived and/or modified CDS sequence (AUadapt) from InfluenzaA__ABU50651__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18287 - RNA, 1410 nt, Artificial Sequence
  derived and/or modified CDS sequence (AUadapt) from InfluenzaA__ABU80180__NA
augaaccccaaccagaagaucaucaccaucggcucggugucccugaccaucgccacgaucugcuuccucaugcagaucgccauccuggucaccaccgugacccugcacuucaagcaguacgagugcaacucguucccgaacaaccaggugaugcucugcgagcccacgaucaucgagcgcaacaucaccgagaucgucuaccugaccaacaccacgaucgagaaggagaucugccccaagcuggcggaguaccggaacugguccaagccccagugcaacaucaccggguucgccccguucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcacccccuaccggacccuccugaugaacgagcugggcgugccguuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgagcucgcuguccgggagcgcccagcacguggaggagugcuccugcuacccccgcuaccccggcgugcggugcgucugccgcgacaacuggaagggcucgaaccggcccaucguggacaucaacgugaaggacuacuccaucgucagcuccuacgugugcucggggcucgugggcgacaccccgcgcaagaacgacuccagcuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagacggaggugcuguggaccuccaacucgaucgucguguucugcggcaccuccgggaccuacggcacggggagcuggcccgacggcgccgacaucaaccucaugccgaucuga

SEQ ID NO: 18288 - RNA, 1413 nt, Artificial Sequence; identical to SEQ ID NO: 17230
  derived and/or modified CDS sequence (AUadapt) from InfluenzaA__ABU80301__NA

SEQ ID NO: 18289 - RNA, 1413 nt, Artificial Sequence
  derived and/or modified CDS sequence (AUadapt) from InfluenzaA__ABU80312__NA
augaacaccaaccagaagaucaucaccaucggcucgaucuccaucgccaucgggaucaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucaacaucaacaacaccaacgugguggcggggaaggacaagaccucggucacccuggccggcaacuccagccugugcuccaucagcggcugggccaucuacacgaaggacaacuccauccggaucgggucgaagggcgacguguucgugaugcgcgagcccuucaucuccugcagccaccucgagugccggaccuucuuccugacccagggggcccugcucaacgacaagcacuccaacggcaccgucaaggaccgcucgccguaccgggcccugauguccugcccccugggggaggcgcccagccccuacaacucgaaguucgaguccguggccuggagcgccuccgccugccacgacggcaugggcuggcucacgaucgggaucagcggcccggacaacggggcgguggccguccugaaguacaacggcaucaucaccgagaccaucaaguccuggaagaagcgcauccugcggacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuaccccgacaccggcacggugaugugcgugugccgcgacaacuggcacgggagcaaccggccgugggucuccuucaaccagaaccuggacuaccagaucggcuacaucugcucgggcguguucggggacaacccccgccccaaggacggcgagggguccugcaaccccgugaccgucgacggcgcggacggggugaagggcuucagcuacaaguacggcaacgggguguggaucggccggaccaaguccaaccgccugcggaagggguucgagaugaucugggacccgaacggcuggaccgacacggacagcaacuucuccgucaagcaggacgugguggccaucaccgacuggucgggguacagcggcuccuucguccagcaccccgagcucaccggccuggacugcauccgccccugcuucuggguggagcugguccgggggcucccccgcgagaacaccacgaucuggaccucgggcuccagcaucuccuucugcggggugaacagcgacaccgccaacugguccuggccggacggcgccgagcugcccuucaccaucgacaaguga

SEQ ID NO: 18290 - RNA, 1410 nt, Artificial Sequence; identical to SEQ ID NO: 17132
  derived and/or modified CDS sequence (AUadapt) from InfluenzaA__ABU80323__NA

SEQ ID NO: 18291 - RNA, 1410 nt, Artificial Sequence
  derived and/or modified CDS sequence (AUadapt) from InfluenzaA__ABU80334__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagacccuccgcacgcaggaguccgagugcgucugcaucaacgggaccugcaccguggugaugaccgacggcagcgccuccgggaaggcggacacgaagauccuguucaucgaggagggcaagaucauccacaucucgacccugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcggccacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggaccagcaacucgaucguggucuucugcggcaccuccgggacguacggcaccgggagcuggccggacggcgccgacaucaaccugaugcccaucuga

SEQ ID NO: 18292 - RNA, 1410 nt, Artificial Sequence; identical to SEQ ID NO: 16556
  derived and/or modified CDS sequence (AUadapt) from InfluenzaA__ABU92762__NA

SEQ ID NO: 18293 - RNA, 1410 nt, Artificial Sequence
  derived and/or modified CDS sequence (AUadapt) from InfluenzaA__ABU92764__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucauggagcgcaacaucaccgagaucgucuaccugaccaacaccacgaucgagaaggagaucugccccaagcuggcggaguaccggaacugguccaagccgcagugcaacgugaccggguucgcccccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggcguggcugcacgugugcgugaccggggacgacgagaacgccaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggcggacaccaagauccuguucaucgaggagggcaagaucgugcacaucagcacgcugucgggguccgcccagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggaagaaggaggagaccgaggucugguggaccagcaacucgaucgugguguucugcggcaccuccgggaccuacggcacggggagcuggccggacggcgccgacaucaaccugaugcccaucuga

SEQ ID NO: 18294 - RNA, 1410 nt, Artificial Sequence; identical to SEQ ID NO: 16556
  derived and/or modified CDS sequence (AUadapt) from InfluenzaA__ABU92765__NA

SEQ ID NO: 18295 - RNA, 1410 nt, Artificial Sequence; identical to SEQ ID NO: 16556
  derived and/or modified CDS sequence (AUadapt) from InfluenzaA__ABU92766__NA

SEQ ID NO: 18296 - RNA, 1410 nt, Artificial Sequence; identical to SEQ ID NO: 16556
  derived and/or modified CDS sequence (AUadapt) from InfluenzaA__ABU92767__NA

SEQ ID NO: 18297 - RNA, 1410 nt, Artificial Sequence; identical to SEQ ID NO: 16556
  derived and/or modified CDS sequence (AUadapt) from InfluenzaA__ABU92768__NA

SEQ ID NO: 18298 - RNA, 1410 nt, Artificial Sequence; identical to SEQ ID NO: 16463
  derived and/or modified CDS sequence (AUadapt) from InfluenzaA__ABU92769__NA

SEQ ID NO: 18299 - RNA, 1410 nt, Artificial Sequence; identical to SEQ ID NO: 16655
  derived and/or modified CDS sequence (AUadapt) from InfluenzaA__ABU92770__NA

SEQ ID NO: 18300 - RNA, 1410 nt, Artificial Sequence
  derived and/or modified CDS sequence (AUadapt) from InfluenzaA__ABU92771__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccaacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 18301 - RNA, 1410 nt, Artificial Sequence
  derived and/or modified CDS sequence (AUadapt) from InfluenzaA__ABU92772__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaacauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 18302 - RNA, 1410 nt, Artificial Sequence
  derived and/or modified CDS sequence (AUadapt) from InfluenzaA__ABU92773__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaccgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggacccgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccgcacgcaggaguccgagugcgucugcaucaacgggaccugcaccguggugaugaccgacggcucggccuccgggaaggcggacacgaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggagcaagcccaacuccaagcuccagaccaaccgccaggugaucguggagcggggcaaccgcucgggguacuccggcaucuucucggucgagggcaaguccugcaucaaccggugcuucuacguggagcugauccgcgggcggaaggaggagaccgaggugugguggaccagcaacucgaucgucguguucugcggcacguccgggaccuacggcaccgggagcuggccggacggcgccgacaucaaccugaugcccaucuga

SEQ ID NO: 18303 - RNA, 1410 nt, Artificial Sequence
  derived and/or modified CDS sequence (AUadapt) from InfluenzaA__ABU92774__NA
augaaccccaaccgcaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcggaacaucaccgagaccgucuaccugaccaacacgaccaucgagaaggagaucugccccaagcuggcggaguaccgcaacugguccaagccgcagugcaacaucaccggguucgcccccuucagcaaggacaacuccauccggcucucggccggcggggacaucugggugacccgcgagcccuacguguccugcgaccccgacaagugcuaccaguucgcccugggccaggggacgacccugaacaacggccacucgaacgacaccguccacgaccggaccccguaccgcacgcuccugaugaacgagcugggcgugcccuuccaccucgggacccgccaggugugcaucgccugguccagcuccucgugccacgacggcaaggcguggcugcacgucugcgugaccggggacgacgagaacgccaccgccuccuucaucuacaacggccggcugguggacagcaucggguccuggucgaagaagauccuccggacgcaggaguccgagugcgucugcaucaacgggaccugcaccguggugaugaccgacggcucggccuccgggaaggcggacacgaagauccuguucaucgaggagggcaagaucguccacaucagcacccugucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggagcaagcccaacuccaagcuccagaccaaccgccaggugaucguggagcggggcaaccggucgggguacuccggcaucuucucggucgagggcaaguccugcaucaaccgcugcuucuacguggagcugauccgggggcgcaaggaggagaccgaggugugguggaccagcaacucgaucgucguguucugcggcacguccgggaccuacggcaccgggagcuggccggacggcgccgacaucaaccugaugcccaucuga

SEQ ID NO: 18304 - RNA, 1410 nt, Artificial Sequence
  derived and/or modified CDS sequence (AUadapt) from InfluenzaA__ABU92775__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacaagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcgggcacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 18305 - RNA, 1410 nt, Artificial Sequence; identical to SEQ ID NO: 16729
  derived and/or modified CDS sequence (AUadapt) from InfluenzaA__ABU92777__NA

SEQ ID NO: 18306 - RNA, 1410 nt, Artificial Sequence
  derived and/or modified CDS sequence (AUadapt) from InfluenzaA__ABU92778__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggucgaagccgcagugcaacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugagcugguccaaggagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 18307 - RNA, 1410 nt, Artificial Sequence; identical to SEQ ID NO: 16627
  derived and/or modified CDS sequence (AUadapt) from InfluenzaA__ABU92779__NA

SEQ ID NO: 18308 - RNA, 1410 nt, Artificial Sequence; identical to SEQ ID NO: 16627
  derived and/or modified CDS sequence (AUadapt) from InfluenzaA__ABU92780__NA

SEQ ID NO: 18309 - RNA, 1410 nt, Artificial Sequence; identical to SEQ ID NO: 16627
  derived and/or modified CDS sequence (AUadapt) from InfluenzaA__ABU92781__NA

SEQ ID NO: 18310 - RNA, 1410 nt, Artificial Sequence
  derived and/or modified CDS sequence (AUadapt) from InfluenzaA__ABU92782__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggcgcgaggagaccgaggugugguggacgagcaacucgaucgucguguucugcggcaccuccgggaccuacggcaccgggagcuggccggacggcgccgacaucaaccugaugcccaucuga

SEQ ID NO: 18311 - RNA, 1410 nt, Artificial Sequence; identical to SEQ ID NO: 16627
  derived and/or modified CDS sequence (AUadapt) from InfluenzaA__ABU92783__NA

SEQ ID NO: 18312 - RNA, 1410 nt, Artificial Sequence; identical to SEQ ID NO: 16627
  derived and/or modified CDS sequence (AUadapt) from InfluenzaA__ABU92784__NA

SEQ ID NO: 18313 - RNA, 1410 nt, Artificial Sequence; identical to SEQ ID NO: 16627
  derived and/or modified CDS sequence (AUadapt) from InfluenzaA__ABU92785__NA

SEQ ID NO: 18314 - RNA, 1410 nt, Artificial Sequence; identical to SEQ ID NO: 16627
  derived and/or modified CDS sequence (AUadapt) from InfluenzaA__ABU92786__NA

SEQ ID NO: 18315 - RNA, 1410 nt, Artificial Sequence
  derived and/or modified CDS sequence (AUadapt) from InfluenzaA__ABU92787__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcucgugcuacccccggcaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggagcggggcaaccgcucgggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 18316 - RNA, 1410 nt, Artificial Sequence
  derived and/or modified CDS sequence (AUadapt) from InfluenzaA__ABU92789__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcucgaucaccggguucgcgcccuucuccaaggacaacagcauccgccuguccgccggcggggacaucugggucacccgggagcccuacgugucgugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuacccgggcguccggugcgugugccgcgacaacuggaaggggucgaaccggcccaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagucccgcagcggcuacgagaccuucaaggucaucgaggggugguccaacccgaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggacguacggcaccggguccuggcccgacggcgccgacaucaaccugaugcccaucuga

SEQ ID NO: 18317 - RNA, 1410 nt, Artificial Sequence; identical to SEQ ID NO: 16729
  derived and/or modified CDS sequence (AUadapt) from InfluenzaA__ABU92790__NA

SEQ ID NO: 18318 - RNA, 1410 nt, Artificial Sequence
  derived and/or modified CDS sequence (AUadapt) from InfluenzaA__ABU92791__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaccgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 18319 - RNA, 1410 nt, Artificial Sequence
  derived and/or modified CDS sequence (AUadapt) from InfluenzaA__ABU92792__NA
augaaccccaaccagaagaucaucaccaucggcucggugucccugaccaucagcacgaucugcuucuucaugcagaucgccauccucaucaccaccgucacccugcacuucaagcaguacguguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccagcuucaucuacaacgggcgccuggucgacuccguggugucgugguccaaggacauccugcggacccaggagagcgagugcgucugcaucaacggcacgugcaccguggugaugaccgacggguccgccucgggcaaggccgacaccaagauccucuucaucgaggagggcaagaucguccacacgagcacccuguccgggagcgcgcagcacguggaggagugcuccugcuacccccgcuaccccggcgugcggugcgucugccgcgacaacuggaaggggucgaaccggccgaucguggacaucaacaucaagaacuacuccaucgugagcuccuacgucugcagcggccuggugggcgacacgccccgcaagaccgacuccucguccagcucccacugccucgaccccaacaacgaggagggcgggcacggggucaagggcugggccuucgacgacgggaacgacguguggaugggccggaccaucucggagaagcugcgccugggcuacgagaccuucaaggugaucgaggggugguccaaccccaacagcaagcuccagaucaaccggcaggucaucguggaccgcggcaaccgguccggguacagcggcaucuucuccguggagggcaagucgugcaucaaccgcugcuucuacgucgagcugauccgggggcgcaaggaggagaccgaggugcuguggaccagcaacuccaucguggucuucugcggcacgagcgggaccuacggcaccggguccuggccggacggcgccgacaucaaccucaugcccaucuga

SEQ ID NO: 18320 - RNA, 1410 nt, Artificial Sequence; identical to SEQ ID NO: 17209
  derived and/or modified CDS sequence (AUadapt) from InfluenzaA__ABU92793__NA

SEQ ID NO: 18321 - RNA, 1410 nt, Artificial Sequence; identical to SEQ ID NO: 18316
  derived and/or modified CDS sequence (AUadapt) from InfluenzaA__ABU92794__NA

SEQ ID NO: 18322 - RNA, 1410 nt, Artificial Sequence; identical to SEQ ID NO: 16627
  derived and/or modified CDS sequence (AUadapt) from InfluenzaA__ABU92795__NA

SEQ ID NO: 18323 - RNA, 1410 nt, Artificial Sequence; identical to SEQ ID NO: 16627
  derived and/or modified CDS sequence (AUadapt) from InfluenzaA__ABU92796__NA

SEQ ID NO: 18324 - RNA, 1410 nt, Artificial Sequence
  derived and/or modified CDS sequence (AUadapt) from InfluenzaA__ABU92797__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacaagaacgccaccgccuccuucaucuacaacggccggcugguggacagcaucggguccuggucgaagcgcauccuccggacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcagcugcuacccccgcuaccccggcgugcggugcgucugccgcgacaacuggaagggcuccaaccggccgaucguggacaucaacgugaaggacuacucgaucgucuccucguacgugugcuccgggcucgugggcgacacgccccgcaagaacgacagcuucuccucgucccacugccuggaccccaacaacgaggagggcggccacggggucaagggcugggccuucgacgacggcaacgacguguggauggggcggaccaucaacgagaagcugcgcagcggcuacgagaccuucaaggucaucgaggggugguccaagcccaacucgaagcuccagaucaaccgccaggugaucguggagcggggcaaccgguccggguacucgggcaucuucuccgucgagggcaagagcugcaucaaccgcugcuucuacguggagcugauccgggggcgcaaggaggagaccgaggugugguggacguccaacucgaucgucguguucugcggcaccagcgggaccuacggcaccggguccuggccggacggcgccgacaucaaccugaugcccaucuga

SEQ ID NO: 18325 - RNA, 1410 nt, Artificial Sequence; identical to SEQ ID NO: 16627
  derived and/or modified CDS sequence (AUadapt) from InfluenzaA__ABU92798__NA

SEQ ID NO: 18326 - RNA, 1410 nt, Artificial Sequence; identical to SEQ ID NO: 16627
  derived and/or modified CDS sequence (AUadapt) from InfluenzaA__ABU92799__NA

SEQ ID NO: 18327 - RNA, 1410 nt, Artificial Sequence; identical to SEQ ID NO: 16627
  derived and/or modified CDS sequence (AUadapt) from InfluenzaA__ABU92800__NA

SEQ ID NO: 18328 - RNA, 1410 nt, Artificial Sequence
  derived and/or modified CDS sequence (AUadapt) from InfluenzaA__ABU92801__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucguccaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggagcaagcccaacuccaagcuccagaucaaccgccaggugaucguggagcggggcaaccgcucgggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 18329 - RNA, 1410 nt, Artificial Sequence; identical to SEQ ID NO: 16627
  derived and/or modified CDS sequence (AUadapt) from InfluenzaA__ABU92802__NA

SEQ ID NO: 18330 - RNA, 1410 nt, Artificial Sequence; identical to SEQ ID NO: 16627
  derived and/or modified CDS sequence (AUadapt) from InfluenzaA__ABU92804__NA

SEQ ID NO: 18331 - RNA, 1410 nt, Artificial Sequence
  derived and/or modified CDS sequence (AUadapt) from InfluenzaA__ABU92805__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaaccugaugcccaucuga

SEQ ID NO: 18332 - RNA, 1410 nt, Artificial Sequence; identical to SEQ ID NO: 18331
  derived and/or modified CDS sequence (AUadapt) from InfluenzaA__ABU92806__NA

SEQ ID NO: 18333 - RNA, 1410 nt, Artificial Sequence
  derived and/or modified CDS sequence (AUadapt) from InfluenzaA__ABU92808__NA
augaaccccaaccagaagaucaucaccaucggcucggugucccugaccaucgccacgaucugcuuccucaugcagaucaccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggccgaguaccggaacugguccaagccgcagugcaacaucaccggguucgcgcccuucagcaaggacaacuccauccgccucucggccggcggggacaucugggugacccgggagcccuacguguccugcgaccccgacaagugcuaccaguucgcccugggccaggggacgacccugaacaacggccacagcaacgacaccguccacgaccgcaccccguaccggacgcuccugaugaacgagcugggcgugcccuuccaccucgggacccgccaggugugcaucgccugguccucguccucgugccacgacggcaaggccuggcugcacgucugcgugaccggggacgacaagaacgcgaccgccuccuucaucuacaacggccggcugguggacagcaucggguccuggucgaagaagauccuccgcacgcaggaguccgagugcgucugcaucaacgggaccugcaccguggugaugaccgacggcagcgccuccgggaaggccgacacgaagauccuguucaucgaggagggcaagaucauccacaucucgacccugagcggguccgcgcagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguccagcuccucgcacugccuggaccccaacaacgaggagggcggccacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggucaucguggagcggggcaaccgcuccggguacucgggcaucuucuccguggagggcaagagcugcaucaaccggugcuucuacgucgagcugauccgcgggcggaaggaggagaccgaggugugguggaccucgaacuccaucguggucuucugcggcaccagcgggacguacggcaccggguccuggccggacggcgccgacaucaaccugaugcccaucuga

SEQ ID NO: 18334 - RNA, 1410 nt, Artificial Sequence
  derived and/or modified CDS sequence (AUadapt) from InfluenzaA__ABU92809__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgacgugcuguggaccagcaacuccaucgucguguucugcgggaccagcggcacguacgggaccggcuccuggccggacggggccgacaucaaccugaugcccaucuga

SEQ ID NO: 18335 - RNA, 1410 nt, Artificial Sequence
  derived and/or modified CDS sequence (AUadapt) from InfluenzaA__ABU92810__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagggcgggaaccggagcggcuacuccggcaucuucucggucgaggggaaguccugcaucaaccgcugcuucuacguggagcugauccggggccgcaaggaggagaccgaggugugguggacgagcaacucgaucgucguguucugcgggaccuccggcaccuacgggaccggcagcuggccggacggcgccgacaucaaccugaugcccaucuga

SEQ ID NO: 18336 - RNA, 1410 nt, Artificial Sequence
  derived and/or modified CDS sequence (AUadapt) from InfluenzaA__ABU92811__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaugaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccgugggcgacaucugggugacccgggagcccuacgucuccugcgaccccgacaagugcuaccaguucgcccuggggcagggcaccacccugaacaacgggcacagcaacgacacggugcacgaccgcaccccguaccggacccuccugaugaacgagcugggcgugcccuuccaccucggcacccgccaggucugcaucgcgugguccucguccagcugccacgacgggaaggccuggcugcacgugugcgugacgggcgacgacaagaacgccaccgccuccuucaucuacaacgggcggcuggucgacucgaucggcuccuggagcaagaagauccuccgcacccaggaguccgagugcgugugcaucaacgggaccugcacgguggucaugaccgacggcucggcguccggcaaggccgacaccaagauccuguucaucgaggaggggaagaucgugcacaucagcacccugucgggcuccgcccagcacguggaggagugcucgugcuacccccgguaccccgggguccgcugcgugugccgggacaacuggaagggcuccaaccgcccgaucguggacaucaacgucaaggacuacagcaucguguccucguacgugugcuccggccucgucggggacacgccccggaagaacgacagcuucuccucgucccacugccuggaccccaacaacgaggagggcgggcacggcgugaaggggugggccuucgacgacggcaacgacgucuggaugggccgcaccaucagcgagaagcugcgguccggguacgagaccuucaaggugaucgagggcuggucgaagcccaacuccaagcuccagaucaaccgccaggugaucgucgagcgggggaaccgcagcggcuacuccgggaucuucucgguggagggcaaguccugcaucaaccggugcuucuacguggagcugauccgcggccggaaggaggagaccgaggucugguggacgagcaacucgaucgugguguucugcgggaccuccggcaccuacgggaccggcagcuggccggacggggccgacaucaaccugaugcccaucuga

SEQ ID NO: 18337 - RNA, 1410 nt, Artificial Sequence; identical to SEQ ID NO: 16627
  derived and/or modified CDS sequence (AUadapt) from InfluenzaA__ABU92814__NA

SEQ ID NO: 18338 - RNA, 1410 nt, Artificial Sequence; identical to SEQ ID NO: 17116
  derived and/or modified CDS sequence (AUadapt) from InfluenzaA__ABU92815__NA

SEQ ID NO: 18339 - RNA, 1410 nt, Artificial Sequence; identical to SEQ ID NO: 16627
  derived and/or modified CDS sequence (AUadapt) from InfluenzaA__ABU92816__NA

SEQ ID NO: 18340 - RNA, 1410 nt, Artificial Sequence
  derived and/or modified CDS sequence (AUadapt) from InfluenzaA__ABU92817__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacaagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgaguccaagagcugcaucaaccggugcuucuacguggagcugauccgcggccggaaggaggagaccgaggugugguggacgucgaacuccaucgucguguucugcgggaccagcggcaccuacgggaccggcuccuggccggacggggccgacaucaaccugaugcccaucuga

SEQ ID NO: 18341 - RNA, 1410 nt, Artificial Sequence; identical to SEQ ID NO: 16627
  derived and/or modified CDS sequence (AUadapt) from InfluenzaA__ABU92818__NA

SEQ ID NO: 18342 - RNA, 1410 nt, Artificial Sequence; identical to SEQ ID NO: 16627
  derived and/or modified CDS sequence (AUadapt) from InfluenzaA__ABU92819__NA

SEQ ID NO: 18343 - RNA, 1410 nt, Artificial Sequence; identical to SEQ ID NO: 16627
  derived and/or modified CDS sequence (AUadapt) from InfluenzaA__ABU92821__NA

SEQ ID NO: 18344 - RNA, 1410 nt, Artificial Sequence; identical to SEQ ID NO: 16627
  derived and/or modified CDS sequence (AUadapt) from InfluenzaA__ABU92822__NA

SEQ ID NO: 18345 - RNA, 1410 nt, Artificial Sequence; identical to SEQ ID NO: 16539
  derived and/or modified CDS sequence (AUadapt) from InfluenzaA__ABU92823__NA

SEQ ID NO: 18346 - RNA, 1410 nt, Artificial Sequence
  derived and/or modified CDS sequence (AUadapt) from InfluenzaA__ABU92824__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggcgcaacgacucguucuccagcucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 18347 - RNA, 1410 nt, Artificial Sequence
  derived and/or modified CDS sequence (AUadapt) from InfluenzaA__ABU92825__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagucccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggacguacggcaccggguccuggccggacggcgccgacaucaaccugaugcccaucuga

SEQ ID NO: 18348 - RNA, 1410 nt, Artificial Sequence; identical to SEQ ID NO: 18347
  derived and/or modified CDS sequence (AUadapt) from InfluenzaA__ABU92826__NA

SEQ ID NO: 18349 - RNA, 1410 nt, Artificial Sequence; identical to SEQ ID NO: 16627
  derived and/or modified CDS sequence (AUadapt) from InfluenzaA__ABU92827__NA

SEQ ID NO: 18350 - RNA, 1410 nt, Artificial Sequence; identical to SEQ ID NO: 16627
  derived and/or modified CDS sequence (AUadapt) from InfluenzaA__ABU92828__NA

SEQ ID NO: 18351 - RNA, 1410 nt, Artificial Sequence; identical to SEQ ID NO: 17116
  derived and/or modified CDS sequence (AUadapt) from InfluenzaA__ABU92829__NA

SEQ ID NO: 18352 - RNA, 1410 nt, Artificial Sequence
  derived and/or modified CDS sequence (AUadapt) from InfluenzaA__ABU92830__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccgcugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 18353 - RNA, 1410 nt, Artificial Sequence; identical to SEQ ID NO: 16627
  derived and/or modified CDS sequence (AUadapt) from InfluenzaA__ABU92831__NA

SEQ ID NO: 18354 - RNA, 1410 nt, Artificial Sequence; identical to SEQ ID NO: 16627
  derived and/or modified CDS sequence (AUadapt) from InfluenzaA__ABU92832__NA

SEQ ID NO: 18355 - RNA, 1410 nt, Artificial Sequence; identical to SEQ ID NO: 16627
  derived and/or modified CDS sequence (AUadapt) from InfluenzaA__ABU92833__NA

SEQ ID NO: 18356 - RNA, 1410 nt, Artificial Sequence
  derived and/or modified CDS sequence (AUadapt) from InfluenzaA__ABU92834__NA
augaaccccaaccagaagaucaucaccaucggcucggugucccugaccaucgccgccaucugcuuccucaugcacaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacgagaacgccaccgccuccuucaucuacaacggccggcugguggacucgaucggguccuggagcaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuucuccucgucccacugccuggaccccaacaacgaggagggcggccacggggucaagggcugggccuucgacgacggcaacgacguguggauggggcgcaccaucagcgagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucucccugaugcccaucuga

SEQ ID NO: 18357 - RNA, 1410 nt, Artificial Sequence; identical to SEQ ID NO: 16627
  derived and/or modified CDS sequence (AUadapt) from InfluenzaA__ABU92835__NA

SEQ ID NO: 18358 - RNA, 1410 nt, Artificial Sequence; identical to SEQ ID NO: 16627
  derived and/or modified CDS sequence (AUadapt) from InfluenzaA__ABU92836__NA

SEQ ID NO: 18359 - RNA, 1410 nt, Artificial Sequence
  derived and/or modified CDS sequence (AUadapt) from InfluenzaA__ABU92837__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgccucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcgucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18360 - RNA, 1410 nt, Artificial Sequence; identical to SEQ ID NO: 16627
  derived and/or modified CDS sequence (AUadapt) from InfluenzaA__ABU92838__NA

SEQ ID NO: 18361 - RNA, 1410 nt, Artificial Sequence; identical to SEQ ID NO: 16463
  derived and/or modified CDS sequence (AUadapt) from InfluenzaA__ABU92839__NA

SEQ ID NO: 18362 - RNA, 1410 nt, Artificial Sequence
  derived and/or modified CDS sequence (AUadapt) from InfluenzaA__ABU92840__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacaucagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccagccacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccgggacaaccgguccggcuacucggggaucuucuccgucgagggcaagagcugcaucaaccgcugcuucuacguggagcugauccggggccgcaagcaggagaccgaggugcucuggacgucgaacuccaucgucguguucugcgggaccagcggcaccuacgggaccggcuccuggccggacggggccgacaucaaccugaugcccaucuga

SEQ ID NO: 18363 - RNA, 1410 nt, Artificial Sequence
  derived and/or modified CDS sequence (AUadapt) from InfluenzaA__ABU92841__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccgggacaaccgguccggcuacucggggaucuucuccgucgagggcaagagcugcaucaaccgcugcuucuacguggagcugauccggggccgcaagcaggagaccgaggugcucuggaccucgaacuccaucgucguguucugcgggaccagcggcaccuacgggacgggcuccuggccggacggggccgacaucaaccugaugcccaucuga

SEQ ID NO: 18364 - RNA, 1410 nt, Artificial Sequence
  derived and/or modified CDS sequence (AUadapt) from InfluenzaA__ABU92842__NA
augaaccccaaccagaagaucaucaccaucggcucggugucccugaccaucgccacgaucugcuuccucaugcagaucgccauccuggucaccaccgugacccugcacuucaagcaguacgacugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccucgugccacgacggcaaggcguggcugcacgugugcgugaccggggacgacgagaacgccaccgccuccuucaucuacaacggccgccugguggacagcaucggguccuggucgaagaagauccuccggacccaggaguccgagugcgucugcaucaacggcacgugcaccguggugaugaccgacggcagcgccuccgggaaggcggacaccaagauccuguucaucgaggagggcaagaucguccacacgucgcugcucagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcuggugggcgacacgccccgcaagaacgacucguccagcuccucgcacugccuggaccccaacaacgaggagggcgggcacggggucaagggcugggccuucgacgacggcaacgacguguggauggggcggaccaucuccgagaagcuccgcucgggcuacgagaccuucaaggucaucgaggggugguccaagcccaacagcaagcugcagaucaaccgccaggugaucguggaccggggcaaccgguccggguacucgggcaucuucuccgucgagggcaagagcugcaucaaccgcugcuucuacguggagcugauccgggggcgcaagcaggagaccgaggugcucuggaccucgaacuccaucgucguguucugcggcaccagcgggaccuacggcacgggguccuggccggacggcgccgacaucaaccugaugcccaucuga

SEQ ID NO: 18365 - RNA, 1410 nt, Artificial Sequence; identical to SEQ ID NO: 16463
  derived and/or modified CDS sequence (AUadapt) from InfluenzaA__ABU92843__NA

SEQ ID NO: 18366 - RNA, 1410 nt, Artificial Sequence; identical to SEQ ID NO: 18151
  derived and/or modified CDS sequence (AUadapt) from InfluenzaA__ABU92844__NA

SEQ ID NO: 18367 - RNA, 1410 nt, Artificial Sequence; identical to SEQ ID NO: 16463
  derived and/or modified CDS sequence (AUadapt) from InfluenzaA__ABU92845__NA

SEQ ID NO: 18368 - RNA, 1410 nt, Artificial Sequence; identical to SEQ ID NO: 16463
  derived and/or modified CDS sequence (AUadapt) from InfluenzaA__ABU92846__NA

SEQ ID NO: 18369 - RNA, 1410 nt, Artificial Sequence; identical to SEQ ID NO: 16463
  derived and/or modified CDS sequence (AUadapt) from InfluenzaA__ABU92847__NA

SEQ ID NO: 18370 - RNA, 1410 nt, Artificial Sequence; identical to SEQ ID NO: 16463
  derived and/or modified CDS sequence (AUadapt) from InfluenzaA__ABU92848__NA

SEQ ID NO: 18371 - RNA, 1410 nt, Artificial Sequence; identical to SEQ ID NO: 17116
  derived and/or modified CDS sequence (AUadapt) from InfluenzaA__ABU92849__NA

SEQ ID NO: 18372 - RNA, 1410 nt, Artificial Sequence
  derived and/or modified CDS sequence (AUadapt) from InfluenzaA__ABU92850__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggucgaguaccggaacuggucgaagccgcagugcgacaucaccggguucgcccccuucuccaaggacaacagcauccgccuguccgcgggcggggacaucugggugacccgggagcccuacgugagcugcgaccccgacaagugcuaccaguucgcccucggccaggggaccacgcugaacaacguccacuccaacgacaccgugcacgaccgcaccccguaccggacccugcucaugacggagcugggcgugcccuuccaccugggcaccaagcaggucugcaucgccuggucguccagcuccugccacgacgggaaggccuggcuccacgugugcgugaccggcgacgacaagaacgccaccgcgucguucaucuacaacgggcgccuggucgacuccaucgugagcugguccaagaagauccugcggacgcaggagagcgagugcgugugcaucaacgggaccugcaccgucgugaugaccgacggguccgccucgggcaaggccgacacgaagauccucuucaucgaggagggcaagaucgugcacaccagcacccuguccgggucggcccagcacgucgaggagugcuccugcuacccccgcuaccccggcgugcggugcgugugccgcgacaacuggaaggggagcaaccggccgaucgucgacaucaacaucaaggacuacuccaucgugagcuccuacgugugcucgggccuggucggcgacacgccccgcaagaacgacuccagcuccucgucccacugccucgaccccaacaacgaggagggcggccacggggugaagggcugggcguucgacgacgggaacgacgucuggaugggccggaccaucagcgagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaacgagguccuguggaccuccaacagcaucgugguguucugcggcaccuccgggacguacggcaccgggagcuggccggacggcgccgacaucaaccugaugcccaucuga

SEQ ID NO: 18373 - RNA, 1410 nt, Artificial Sequence
  derived and/or modified CDS sequence (AUadapt) from InfluenzaA__ABU92851__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcuccaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaaggacgacucguccagcuccucgcacugccucgaccccaacaacgaggagggcgggcacggggucaagggcugggccuucgacgacgggaacgacguguggaugggccggaccaucuccgagaagucccgcagcggcuacgagaccuucaaggucaucgagggguggagcaaccccaacuccaagcugcagaucaaccgccaggugaucguggaccggggcaaccggucgggguacagcggcaucuucuccgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 18374 - RNA, 1410 nt, Artificial Sequence; identical to SEQ ID NO: 16627
  derived and/or modified CDS sequence (AUadapt) from InfluenzaA__ABU92852__NA

SEQ ID NO: 18375 - RNA, 1410 nt, Artificial Sequence
  derived and/or modified CDS sequence (AUadapt) from InfluenzaA__ABU92853__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaagaaccaggugaugcucugcgagcccaccaucaucgagcgcaacaucacggagaucgucuacaugaccaacaccaccaucgagaaggagaucugccccaagcuggccgaguaccggaacugguccaagccgcagugcaacaucacgggguucgcccccuucagcaaggacaacuccauccgccugucggccggcggggacaucugggugacccgggagcccuacguguccugcgaccccgacaagugcuaccaguucgcccucggccaggggaccacccugaacaacggccacagcaacgacacgguccacgaccgcaccccguaccggacccugcucaugaacgagcugggcgugcccuuccaccuggggacccgccaggugugcaucgcgugguccucguccagcugccacgacggcaaggccuggcuccacgucugcgugacgggggacgacaagaacgccaccgccuccuucaucuacaacggccggcugguggacucgaucgucuccuggagcaagaagauccugcgcacccaggaguccgagugcgugugcaucaacgggaccugcacgguggucaugaccgacggcucggcguccggcaaggccgacaccaagauccucuucaucgaggaggggaagaucgugcacaucagcacccugucgggcuccgcccagcacguggaggagugcucgugcuacccccgguaccccgggguccgcugcgugugccgggacaacuggaagggcuccaaccgcccgaucguggacaucaacgucaaggacuacagcaucguguccucguacgugugcuccggccuggucggggacacgccccggaagaacgacagcuucuccucgucccacugccucgaccccaacaacgaggagggcgggcacggcgugaaggggugggccuucgacgacggcaacgacgucuggaugggccgcaccaucagcgagaagcugcgguccggguacgagaccuucaaggugaucgagggcuggucgaagcccaacuccaagcugcagaucaaccgccaggugaucgucgagcgggggaaccgcagcggcuacuccgggaucuucucgguggagggcaaguccugcaucaaccggugcuucuacguggagcucauccgcggccggaaggaggagaccgaggucugguggacgagcaacucgaucgugguguucugcgggaccuccggcaccuacgggaccggcagcuggccggacggggccgacaucaaccugaugcccaucuga

SEQ ID NO: 18376 - RNA, 1410 nt, Artificial Sequence; identical to SEQ ID NO: 16627
  derived and/or modified CDS sequence (AUadapt) from InfluenzaA__ABU92854__NA

SEQ ID NO: 18377 - RNA, 1410 nt, Artificial Sequence
  derived and/or modified CDS sequence (AUadapt) from InfluenzaA__ABU92855__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucaucgagcggggcaaccgcagcggguacuccggcaucuucucgguggagggcaaguccugcaucaaccggugcuucuacgucgagcugauccgcgggcggaaggaggagaccgaggugugguggacgagcaacucgaucguggucuucugcggcaccuccgggaccuacggcaccgggagcuggccggacggcgccgacaucaaccugaugcccaucuga

SEQ ID NO: 18378 - RNA, 1410 nt, Artificial Sequence; identical to SEQ ID NO: 16547
  derived and/or modified CDS sequence (AUadapt) from InfluenzaA__ABU92856__NA

SEQ ID NO: 18379 - RNA, 1410 nt, Artificial Sequence; identical to SEQ ID NO: 16627
  derived and/or modified CDS sequence (AUadapt) from InfluenzaA__ABU92857__NA

SEQ ID NO: 18380 - RNA, 1410 nt, Artificial Sequence
  derived and/or modified CDS sequence (AUadapt) from InfluenzaA__ABU92858__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18381 - RNA, 1410 nt, Artificial Sequence
  derived and/or modified CDS sequence (AUadapt) from InfluenzaA__ABU92859__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccggguaccggaacugguccaagccgcagugcaacaucacgggcuucgcccccuucagcaaggacaacuccauccgccucucggccgggggcgacaucugggugacccgggagcccuacguguccugcgaccccgacaagugcuaccaguucgcccuggggcagggcaccacccugaacaacggccacagcaacgacacgguccacgaccgcaccccguaccggacccuccugaugaacgagcugggggugcccuuccaccucggcacccgccaggugugcaucgcgugguccucguccucgugccacgacgggaaggccuggcugcacgucugcgugacgggcgacgacaagaacgccaccgccuccuucaucuacaacgggcggcugguggacagcaucggcuccuggucgaagaagauccuccgcacccaggaguccgagugcgucugcaucaacgggaccugcacgguggugaugaccgacggcagcgcguccggcaaggccgacaccaagauccuguucaucgaggaggggaagaucguccacaucucgacccugagcggcuccgcccagcacguggaggagugcucgugcuacccccgguaccccggcgugcgcugcgucugccgggacaacuggaagggguccaaccgcccgaucguggacaucaacgugaaggacuacucgaucgucuccagcuacgugugcuccggccucgugggggacacgccccggaagaacgacucguucuccagcucccacugccuggaccccaacaacgaggagggcgggcacggcgucaagggcugggccuucgacgacgggaacgacguguggaugggccgcaccaucucggagaagcugcgguccggguacgagaccuucaaggucaucgagggcuggucgaagcccaacuccaagcuccagaucaaccgccaggugaucguggagcgggggaaccgcagcggcuacuccggcaucuucucggucgaggggaaguccugcaucaaccggugcuucuacguggagcugauccgcggccggaaggaggagaccgaggugugguggacgagcaacucgaucgucguguucugcgggaccuccggcaccuacgggaccggcagcuggccggacggcgccgacaucaaccugaugcccaucuga

SEQ ID NO: 18382 - RNA, 1410 nt, Artificial Sequence
  derived and/or modified CDS sequence (AUadapt) from InfluenzaA__ABU92860__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacaagaacgccaccgccuccuucaucuacaacggccggcugguggacucgaucggguccugguacaagaagauccuccgcacccaggagucggagugcgucugcaucaacgggaccugcacgguggugaugaccgacggcuccgcgagcgggaaggccgacaccaagauccuguucaucgaggagggcaagaucguccacaucuccacccugucggggagcgcccagcacguggaggagugcuccugcuacccccgguaccccggcgugcgcugcgucugccgggacaacuggaagggcucgaaccgcccgaucguggacaucaacgugaaggacuacuccaucaucagcuccuacgucugcucggggcucgugggcgacacgccccggaagaacgacuccuucucguccagccacugccuggaccccaacaacgaggagggcggccacggggugaagggcugggccuucgacgacggcaacgacgucuggauggggcgcaccaucuccgagaagcugcggucgggcuacgagaccuucaaggugaucgaggggugguccaagcccaacagcaagcuccagaucaaccgccaggucaucguggagcggggcaaccgcuccggguacucgggcaucuucuccguggagggcaagagcugcaucaaccggugcuucuacgucgagcugauccgcgggcggaaggaggagaccgaggugugguggacguccaacucgaucguggucuucugcggcaccagcgggaccuacggcaccggguccuggccggacggcgccgacaucaaccugaugcccaucuga

SEQ ID NO: 18383 - RNA, 1410 nt, Artificial Sequence
  derived and/or modified CDS sequence (AUadapt) from InfluenzaA__ABU92861__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcauggcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaaccugaugcccaucuga

SEQ ID NO: 18384 - RNA, 1410 nt, Artificial Sequence
  derived and/or modified CDS sequence (AUadapt) from InfluenzaA__ABU92862__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagccgcgacaacuccauccggcucucggccggcggggacaucugggugacccgcgagcccuacguguccugcgaccccgacaagugcuaccaguucgcccugggccaggggaccacccugaacaacggccacagcaacgacacgguccacgaccggaccccguaccgcacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccggacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguucuccagcucccacugccuggaccccaacaacgaggagggcggccacggggucaagggcugggccuucgacgacggcaacgacguguggauggggcggaccaucucggagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggacgagcaacucgaucgucguguucugcggcaccuccgggaccuacggcaccgggagcuggccggacggcgccgacaucaaccugaugcccaucuga

SEQ ID NO: 18385 - RNA, 1410 nt, Artificial Sequence; identical to SEQ ID NO: 16627
  derived and/or modified CDS sequence (AUadapt) from InfluenzaA__ABU92863__NA

SEQ ID NO: 18386 - RNA, 1410 nt, Artificial Sequence
  derived and/or modified CDS sequence (AUadapt) from InfluenzaA__ABU92865__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccucgacaagugcuaccaguucgcccugggccaggggaccacgcugaacaacgugcacuccaacgacaccguccacgaccgcacccccuaccggacccuccugaugaacgagcugggcgugccguuccaccucggcacgaagcaggucugcaucgccuggucguccagcuccugccacgacgggaaggccuggcugcacgugugcgugaccggcgacgacaagaacgcgaccgccucguucaucuacaacgggcgccugguggacuccaucgucagcugguccaagaagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggcccaucguggacaucaacaucaaggacuacuccaucgucagcuccuacgugugcucgggccucgugggcgacaccccgcgcaagaacgacuccagcuccucgucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggcccgacggcgccgacaucaaccucaugccgaucuga

SEQ ID NO: 18387 - RNA, 1410 nt, Artificial Sequence
  derived and/or modified CDS sequence (AUadapt) from InfluenzaA__ABU92866__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugucgugguccaaggagauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccaacucgcacugccucgaccccaacaacgaggagggcgggcacggggugaagggcugggccuucgacgacgggaacgacgucuggaugggccggaccaucuccgagaagcugcgcagcggcuacgagaccuucaaggugaucgaggggugguccaaccccaacucgaagcugcagaucaaccgccaggugaucgucgaccggggcaaccgguccggguacagcggcaucuucuccguggagggcaagucgugcaucaaccgcugcuucuacguggagcucauccgggggcgcaaggaggagaccgagguccuguggaccagcaacuccaucgugguguucugcggcaccagcgggacguacggcaccggguccuggccggacggcgccgacaucaaccugaugcccaucuga

SEQ ID NO: 18388 - RNA, 1410 nt, Artificial Sequence; identical to SEQ ID NO: 17209
  derived and/or modified CDS sequence (AUadapt) from InfluenzaA__ABU92867__NA

SEQ ID NO: 18389 - RNA, 1410 nt, Artificial Sequence; identical to SEQ ID NO: 18316
  derived and/or modified CDS sequence (AUadapt) from InfluenzaA__ABU92868__NA

SEQ ID NO: 18390 - RNA, 1410 nt, Artificial Sequence; identical to SEQ ID NO: 17096
  derived and/or modified CDS sequence (AUadapt) from InfluenzaA__ABU92869__NA

SEQ ID NO: 18391 - RNA, 1410 nt, Artificial Sequence; identical to SEQ ID NO: 18286
  derived and/or modified CDS sequence (AUadapt) from InfluenzaA__ABU92870__NA

SEQ ID NO: 18392 - RNA, 1410 nt, Artificial Sequence
  derived and/or modified CDS sequence (AUadapt) from InfluenzaA__ABU92872__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacucgaacgacacgguccacgaccgcaccccguaccggacccuccugaugaacgagcugggcgugcccuuccaccucgggacccgccaggugugcaucgcgugguccagcuccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcucggcguccgggaaggccgacaccaagauccuguucaucgaggagggcaagaucguccacaucagcacccugucgggguccgcccagcacguggaggagugcagcugcuacccccgguaccccggcgugcgcugcgucugccgggacaacuggaagggcuccaaccgcccgaucguggacaucaacgugaaggacuacaacaucgucucguccuacgugugcucggggcucgugggcgacacgccccggaagaacgacuccuucagcuccucgcacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggacguccaacucgaucgucguguucugcggcaccagcgggaccuacggcaccggguccuggccggacggcgccgacaucaaccugaugcccaucuga

SEQ ID NO: 18393 - RNA, 1410 nt, Artificial Sequence
  derived and/or modified CDS sequence (AUadapt) from InfluenzaA__ABU92873__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaagcaggagaccgaggugcuguggaccuccaacagcaucgucguguucugcggcaccuccgggacguacggcaccgggagcuggccggacggcgccgacaucaacaucaugcccaucuga

SEQ ID NO: 18394 - RNA, 1410 nt, Artificial Sequence; identical to SEQ ID NO: 18331
  derived and/or modified CDS sequence (AUadapt) from InfluenzaA__ABU92874__NA

SEQ ID NO: 18395 - RNA, 1410 nt, Artificial Sequence; identical to SEQ ID NO: 16627
  derived and/or modified CDS sequence (AUadapt) from InfluenzaA__ABU92875__NA

SEQ ID NO: 18396 - RNA, 1410 nt, Artificial Sequence; identical to SEQ ID NO: 16627
  derived and/or modified CDS sequence (AUadapt) from InfluenzaA__ABU92876__NA

SEQ ID NO: 18397 - RNA, 1410 nt, Artificial Sequence; identical to SEQ ID NO: 16547
  derived and/or modified CDS sequence (AUadapt) from InfluenzaA__ABU92877__NA

SEQ ID NO: 18398 - RNA, 1410 nt, Artificial Sequence; identical to SEQ ID NO: 16627
  derived and/or modified CDS sequence (AUadapt) from InfluenzaA__ABU92878__NA

SEQ ID NO: 18399 - RNA, 1410 nt, Artificial Sequence
  derived and/or modified CDS sequence (AUadapt) from InfluenzaA__ABU92879__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaagggcgagaccgaggugugguggaccagcaacucgaucgucguguucugcgggaccuccggcaccuacgggacgggcagcuggccggacggcgccgacaucaaccugaugcccaucuga

SEQ ID NO: 18400 - RNA, 1410 nt, Artificial Sequence; identical to SEQ ID NO: 18392
  derived and/or modified CDS sequence (AUadapt) from InfluenzaA__ABU92880__NA

SEQ ID NO: 18401 - RNA, 1410 nt, Artificial Sequence; identical to SEQ ID NO: 16627
  derived and/or modified CDS sequence (AUadapt) from InfluenzaA__ABU92881__NA

SEQ ID NO: 18402 - RNA, 1410 nt, Artificial Sequence; identical to SEQ ID NO: 16627
  derived and/or modified CDS sequence (AUadapt) from InfluenzaA__ABU92882__NA

SEQ ID NO: 18403 - RNA, 1410 nt, Artificial Sequence
  derived and/or modified CDS sequence (AUadapt) from InfluenzaA__ABU92883__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaagaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacaagaacgccaccgccuccuucaucuacaacggccggcugguggacucgaucgucuccuggagcaagaagauccuccgcacccaggaguccgagugcgugugcaucaacgggaccugcacgguggucaugaccgacggcucggcguccggcaaggccgacaccaagauccuguucaucgaggaggggaagaucgugcacaucagcacccugucgggcuccgcccagcacguggaggagugcucgugcuacccccgguaccccgggguccgcugcgugugccgggacaacuggaagggcuccaaccgcccgaucguggacaucaacgucaaggacuacagcaucguguccucguacgugugcuccggccucgucggggacacgccccggaagaacgacagcuucuccucgucccacugccuggaccccaacaacgaggagggcgggcacggcgugaaggggugggccuucgacgacggcaacgacgucuggaugggccgcaccaucagcgagaagcugcgguccggguacgagaccuucaaggugaucgagggcuggucgaagcccaacuccaagcuccagaucaaccgccaggugaucgucgagcgggggaaccgcagcggcuacuccgggaucuucucgguggagggcaaguccugcaucaaccggugcuucuacguggagcugauccgcggccggaaggaggagaccgaggucugguggacgagcaacucgaucgugguguucugcgggaccuccggcaccuacgggaccggcagcuggccggacggggccgacaucaaccugaugcccaucuga

SEQ ID NO: 18404 - RNA, 1410 nt, Artificial Sequence; identical to SEQ ID NO: 16627
  derived and/or modified CDS sequence (AUadapt) from InfluenzaA__ABU92884__NA

SEQ ID NO: 18405 - RNA, 1410 nt, Artificial Sequence; identical to SEQ ID NO: 16627
  derived and/or modified CDS sequence (AUadapt) from InfluenzaA__ABU92885__NA

SEQ ID NO: 18406 - RNA, 1410 nt, Artificial Sequence; identical to SEQ ID NO: 17116
  derived and/or modified CDS sequence (AUadapt) from InfluenzaA__ABU92886__NA

SEQ ID NO: 18407 - RNA, 1410 nt, Artificial Sequence; identical to SEQ ID NO: 16627
  derived and/or modified CDS sequence (AUadapt) from InfluenzaA__ABU92887__NA

SEQ ID NO: 18408 - RNA, 1410 nt, Artificial Sequence
  derived and/or modified CDS sequence (AUadapt) from InfluenzaA__ABU92888__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucaucagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaagguggucgagggguggagcaaccccaacuccaagcugcagaucaaccgccaggugaucguggaccgggacaaccggucgggcuacuccgggaucuucagcgucgagggcaagucgugcaucaaccgcugcuucuacguggagcucauccgggggcgcaaccaggagaccgaggugcuguggaccuccaacagcaucgucguguucugcggcaccuccggcacguacgggaccggcagcuggccggacggggccgacaucaaccugaugcccaucuga

SEQ ID NO: 18409 - RNA, 1410 nt, Artificial Sequence; identical to SEQ ID NO: 18331
  derived and/or modified CDS sequence (AUadapt) from InfluenzaA__ABU92889__NA

SEQ ID NO: 18410 - RNA, 1410 nt, Artificial Sequence
  derived and/or modified CDS sequence (AUadapt) from InfluenzaA__ABU92890__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcuggugcgcgggcggaaggaggagaccgaggucugguggacgagcaacucgaucgugguguucugcggcaccuccgggaccuacggcaccgggagcuggccggacggcgccgacaucaaccugaugcccaucuga

SEQ ID NO: 18411 - RNA, 1410 nt, Artificial Sequence; identical to SEQ ID NO: 18347
  derived and/or modified CDS sequence (AUadapt) from InfluenzaA__ABU92891__NA

SEQ ID NO: 18412 - RNA, 1410 nt, Artificial Sequence
  derived and/or modified CDS sequence (AUadapt) from InfluenzaA__ABU92892__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcgggaacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18413 - RNA, 1410 nt, Artificial Sequence; identical to SEQ ID NO: 17209
  derived and/or modified CDS sequence (AUadapt) from InfluenzaA__ABU92893__NA

SEQ ID NO: 18414 - RNA, 1410 nt, Artificial Sequence
  derived and/or modified CDS sequence (AUadapt) from InfluenzaA__ABU92895__NA
augaaccccaaccagaagaucaucaccgugggcucggucucccugaccaucagcacgaucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccuggucgacuccaucgugucgugguccaaggagauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggacuacuccaucgccucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18415 - RNA, 1410 nt, Artificial Sequence
  derived and/or modified CDS sequence (AUadapt) from InfluenzaA__ABU92896__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcaacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgaccgcaacgacgucuggauggggcggaccaucucggagaagucccgccugggcuacgagaccuucaaggugaucgagggcuggagcaaccccaacuccaagcugcagaucaaccggcaggucaucguggaccgcgggaaccggucgggcuacuccgggaucuucagcguggagggcaagucgugcaucaaccgcugcuucuacgucgagcucauccgggggcgcaaggaggagaccgaggugcuguggaccuccaacagcaucguggucuucugcggcaccuccggcacguacgggaccggcagcuggccggacggggccgacaucaaccugaugcccaucuga

SEQ ID NO: 18416 - RNA, 1410 nt, Artificial Sequence
  derived and/or modified CDS sequence (AUadapt) from InfluenzaA__ABU92897__NA
augaaccccaaccagaagaucaucaccaucggcucggugucccugaccaucagcacgaucugcuucuucaugcagaucgccauccucaucaccaccgucacccugcacuucaagcaguacgagcugaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcaacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccucguccugccacgacgggaaggccuggcugcacgugugcgugaccggcgacgacaagaacgcgaccgccagcuucaucuacaacgggcgccugguggacuccaucgucucgugguccaaggagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccucgugggcgacacgccccgcaagaacgacuccucguccagcucccacugccuggaccccaacaacgaggagggcgggcacggggucaagggcugggccuucgacgacgggaacgacguguggaugggccggaccaucucggagaagucccgcagcggcuacgagaccuucaaggucaucgaggggugguccaaccccaacucgaagcugcagaucaaccgccaggugaucguggaccggggcaaccgguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 18417 - RNA, 1410 nt, Artificial Sequence
  derived and/or modified CDS sequence (AUadapt) from InfluenzaA__ABU92898__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccgucgugucgugguccaaggacauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggucgaaccggccgaucgucgacaucaacaucaagaacuacuccaucgugagcuccuacgugugcucgggccuggucggcgacacgccccgcaagaccgacuccagcuccucgucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccggaccggguacuccggcaucuucagcguggaggggaaguccugcaucaaccgcugcuucuacguggagcugauccggggccgcaaggaggagaccgagguccuguggacgucgaacagcaucgugguguucugcggcaccuccgggaccuacggcaccgggagcuggccggacggcgccgacaucaaccucaugcccaucuga

SEQ ID NO: 18418 - RNA, 1410 nt, Artificial Sequence; identical to SEQ ID NO: 16627
  derived and/or modified CDS sequence (AUadapt) from InfluenzaA__ABU92899__NA

SEQ ID NO: 18419 - RNA, 1410 nt, Artificial Sequence
  derived and/or modified CDS sequence (AUadapt) from InfluenzaA__ABU92900__NA
augaaccccaaccagaagaucaucaccaucggcucggugucccugaccaucgccgccaucugcuuccucaugcagaucgcgauccuggucacgaccgugacccugcacuucaagcagcacgagugcaacccgccgcccaacaaccaggugaugcucugcgagcccaccaucaucgagcgcaacaucacggagaucgucuaccugaccaacaccaccaucgagaaggagaucugccccaagcuggccgaguaccggaacuggucgaagccccagugcaacaucacgggguucgcccccuucuccaaggacaacagcauccgccucuccgccggcggggacaucugggugacccgggagcccuacgugucgugcgacccggacaagugcuaccaguucgcccugggccaggggaccacccugaacaacggccacuccaacgacacgguccacgaccgcacccccuaccggacccuccugaugaacgagcugggcgugcccuuccaccucgggacccgccaggugugcaucgcguggucguccagcuccugccacgacggcaaggccuggcugcacgucugcgugacgggggacgacaagaacgccaccgccucguucaucuacaacggccggcugguggacuccaucgggagcugguccaagaagauccuccgcacccaggagucggagugcgucugcaucaacgggaccugcacgguggugaugaccgacggcuccgcgucggggaaggccgacaccaagauccuguucaucgaggagggcaagaucguccacaucuccacccugagcgggucggcccagcacguggaggagugcuccugcuacccccgguacccgggcgugcgcugcgucugccgggacaacuggaagggcagcaaccgccccaucguggacaucaacgugaaggacuacuccaucgucucguccuacgugugcucggggcucgugggcgacacgccccggaagaacgacuccuucagcuccucgcacugccuggaccccaacaacgaggagggcggccacggggucaagggcugggccuucgacgacggcaacgacguguggauggggcgcaccaucuccgagaagcugcggagcggcuacgagaccuucaaggucaucgaggggugguccaagccgaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggacguccaacucgaucgucguguucugcggcaccagcgggaccuacggcaccggguccuggcccgacggcgccgacaucaaccugaugcccaucuga

SEQ ID NO: 18420 - RNA, 1410 nt, Artificial Sequence
  derived and/or modified CDS sequence (AUadapt) from InfluenzaA__ABU92901__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccagcugccacgacggcaaggccuggcugcacgucugcgugacgggggacgacaagaacgccaccgccuccuucaucuacaacggccggcugguggacucgaucuccagcugguccaagaagauccuccgcacccaggagucggagugcgucugcaucaacgggaccugcacgguggugaugaccgacggcuccgcgagcggcaaggccgacaccaagauccuguucaucgaggaggggaagaucguccacaucucgacccuguccggcucggcccagcacguggaggagugcuccugcuacccccgguaccccggggugcgcugcgucugccgggacaacuggaagggcagcaaccgcccgaucguggacaucaacgugaaggacuacuccaucgucucguccuacgugugcagcggccucgugggggacacgccccggaagaacgacuccuucucguccagccacugccuggaccccaacaacgaggagggcgggcacggcgucaaggggugggccuucgacgacggcaacgacguguggaugggccgcaccaucuccgagaagcugcggucgggguacgagaccuucaaggucaucgagggcugguccaagcccaacagcaagcuccagaucaaccgccaggugaucguggagcgggggaaccgcuccggcuacucggggaucuucuccgucgagggcaagagcugcaucaaccggugcuucuacguggagcugauccgcggccggaaggaggagaccgaggugugguggacgucgaacuccaucgucguguucugcgggaccagcggcaccuacgggaccggcuccuggccggacggggccgacaucaaccugaugcccaucuga

SEQ ID NO: 18421 - RNA, 1410 nt, Artificial Sequence; identical to SEQ ID NO: 16627
  derived and/or modified CDS sequence (AUadapt) from InfluenzaA__ABU92902__NA

SEQ ID NO: 18422 - RNA, 1410 nt, Artificial Sequence; identical to SEQ ID NO: 16627
  derived and/or modified CDS sequence (AUadapt) from InfluenzaA__ABU92903__NA

SEQ ID NO: 18423 - RNA, 1410 nt, Artificial Sequence; identical to SEQ ID NO: 17582
  derived and/or modified CDS sequence (AUadapt) from InfluenzaA__ABU92904__NA

SEQ ID NO: 18424 - RNA, 1410 nt, Artificial Sequence; identical to SEQ ID NO: 16627
  derived and/or modified CDS sequence (AUadapt) from InfluenzaA__ABU92905__NA

SEQ ID NO: 18425 - RNA, 1410 nt, Artificial Sequence
  derived and/or modified CDS sequence (AUadapt) from InfluenzaA__ABU92906__NA
augaaccccaaccagaagaucaucaccaucggcucggugucccugaccaucgccgccaucugcuuccucaugcagaucgcgauccuggucacgaccgugacccugcacuucaagcagcacgagugcaacucgccgcccaacaaccaggugaugcucugcgagcccaccaucaucgagcgcaacaucacggagaucgucuaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggugacccgggagcccuacguguccugcgaccccgacaagugcuaccaguucgcccugggccaggggaccacccugaacaacggccacagcaacgacacgguccacgaccgcaccccguaccggacccuccugaugaacgagcugggcgugcccuuccaccucgggacccgccaggugugcaucgcgugguccucguccucgugccacgacggcaaggccuggcugcacgucugcgugacgggggacgacaagaacgccaccgccuccuucaucuacaacggccggcugguggacagcaucggguccuggucgaagaagauccuccgcacccaggaguccgagugcgucugcaucaacgggaccugcacgguggugaugaccgacggcagcgcguccgggaaggccgacaccaagauccuguucaucgaggagggcaagaucguccacaucucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcggccacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggacgagcaacucgaucgucguguucugcggcaccuccgggaccuacggcaccgggagcuggccggacggcgccgacaucaagcugaugcccaucuga

SEQ ID NO: 18426 - RNA, 1410 nt, Artificial Sequence
  derived and/or modified CDS sequence (AUadapt) from InfluenzaA__ABU92907__NA
augaaccccaaccagaagaucaucaccaucggcucgaucucccugaccaucgccgccaucugcuuccucaugcagaucgcgauccuggugacgaccgucacccugcacuucaagcagcacgagugcaacucgccgcccaacaaccaggugaugcucugcgagcccaccaucaucgagcgcaacaucacggagaucguguaccugaccaacaccaccaucgagaaggagaucugccccaagcuggccgaguaccggaacugguccaagccgcagugcaacaucacgggguucgcccccuucagcaaggacaacuccauccgccucucggccggcggggacaucugggucacccgggagcccuacguguccugcgaccccgacaagugcuaccaguucgcccugggccaggggaccacccugaacaacggccacagcaacgacacggugcacgaccgcaccccguaccggacccuccugaugaacgagcugggcguccccuuccaccucgggacccgccaggugugcaucgcgugguccucguccucgugccacgacggcaaggccuggcugcacgugugcgucacgggggacgacaagaacgccaccgccuccuucaucuacaacggccggcugguggacagcaucggguccuggucgaagaagauccuccgcacccaggaguccgagugcgugugcaucaacgggaccugcacggucgugaugaccgacggcagcgcguccgggaaggccgacaccaagauccuguucaucgaggagggcaagaucgugcacaucucgacccugagcggguccgcccagcacgucgaggagugcucgugcuacccccgguaccccggcgugcgcugcgugugccgggacaacuggaagggcuccaaccgcccgaucgucgacaucaacgugaaggacuacucgaucguguccagcuacgucugcuccgggcucgugggcgacacgccccggaagaacgacucguucuccagcucccacugccuggaccccaacaacgaggagggcggccacggggugaagggcugggccuucgacgacggcaacgacgucuggauggggcgcaccaucucggagaagcugcgguccggcuacgagaccuucaaggugaucgagggguggucgaagcccaacuccaagcuccagaucaaccgccaggucaucguggagcggggcaaccgcagcggguacuccggcaucuucucgguggagggcaaguccugcaucaaccggugcuucuacgucgagcugauccgcgggcggaaggaggagaccgaggugugguggacgagcaacucgaucguggucuucugcggcaccuccgggaccuacggcaccgggagcuggccggacggcgccgacaucaaccugaugcccaucuga

SEQ ID NO: 18427 - RNA, 1410 nt, Artificial Sequence; identical to SEQ ID NO: 16627
  derived and/or modified CDS sequence (AUadapt) from InfluenzaA__ABU92908__NA

SEQ ID NO: 18428 - RNA, 1410 nt, Artificial Sequence; identical to SEQ ID NO: 16627
  derived and/or modified CDS sequence (AUadapt) from InfluenzaA__ABU92909__NA

SEQ ID NO: 18429 - RNA, 1410 nt, Artificial Sequence
  derived and/or modified CDS sequence (AUadapt) from InfluenzaA__ABU92910__NA
augaaccccaaccagaagaucaucaccaucggcucggugucccugaccaucgccacgaucugcuuccucacccagaucgccauccugaucaccaccgucacgcugcacuucaagcaguacgagugcaacucgccgcccaacaaccaggugaugcucugcgagcccaccaucaucgagcgcaacaucaccgagaucguguaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggucacccgggagcccuacguguccugcgaccccgacaagugcuaccaguucgcccugggccaggggacgacccugaacaacggccacucgaacgacaccgugcacgaccgcaccccguaccggacgcuccugaugaacgagcugggcguccccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacagcaucggguccuggucgaagaagauccuccggacgcaggaguccgagugcgugugcaucaacgggaccugcaccgucgugaugaccgacggcucggccuccgggaaggcggacacgaagauccuguucaucgaggagggcaagaucgugcacaccagccugcucucgggguccgcccagcacgucgaggagugcucgugcuacccccgcuaccccggcgugcggugcgugugccgcgacaacuggaagggcuccaaccggccgaucgucgacaucaacgugcgcgacuacagcaucguguccucguacgucugcuccgggcuggugggcgacacgccccggaagaacgacagcuccucguccucgcacugccuggaccccaacaacgaggagggcggccacggggugaagggcugggccuucgacgacggcaacgacgucuggauggggcgcaccaucuccgagaagcuccggagcggcuacgagaccuucaaggugaucgaggggugguccaagcccaacucgaagcugcagaucaaccgccaggucaucguggacaagggcaaccgguccggguacucgggcaucuucuccguggagggcaagagcugcaucaaccgcugcuucuacgucgagcugauccgggggcgcaaccaggagaccgaggugcucuggaccucgaacuccaucguggucuucugcggcaccagcgggacguacggcaccggguccuggccggacggcgccgacaucaaccugaugcccaucuga

SEQ ID NO: 18430 - RNA, 1410 nt, Artificial Sequence
  derived and/or modified CDS sequence (AUadapt) from InfluenzaA__ABU92911__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcaggcggaguaccggaacugguccaagccgcagugcaacaucaccggguucgcccccuucagcaaggacaacuccauccgccugucggccggcggggacaucugggugacccgggagcccuacguguccugcgaccccgacaagugcuaccaguucgcccucggccaggggacgacccugaacaacggccacucgaacgacaccguccacgaccgcaccccguaccggacgcugcucaugaacgagcugggcgugcccuuccaccuggggaccaagcaggucugcaucgccugguccagcuccucgugccacgacggcaaggcguggcuccacgugugcgugaccggggacgacaagaacgccaccgccuccuucaucuacaacggccgccugguggacucgaucggguccuggagcaagaagauccugcggacgcaggaguccgagugcgucugcaucaacgggaccugcaccguggugaugaccgacggcucggccuccgggaaggcggacacgaagauccucuucaucaaggagggcaagaucguccacaccucgcugcugagcggguccgcccagcacguggaggagugcucgugcuacccccgcuaccccggcgugcggugcgucugccgcgacaacuggaagggcuccaaccggccgaucguggacaucaacgugaaggacuacucgaucgucuccagcuacgugugcuccgggcucgugggcgacacgccccgcaagaacgacucguccucguccagccacugccuggaccccaacaacgaggagggcggccacggggucaagggcugggccuucgacgacggcaacgacguguggauggggcggaccaucuccgagaagcugcgcucgggcuacgagaccuucaaggucaucgaggggugguccaagcccaacucgaagcuccagaucaaccgccaggugaucguggaccgggacaaccgguccggcuacagcgggaucuucuccgucgagggcaagucgugcaucaaccgcugcuucuacguggagcugauccggggccgcaaccaggagaccgaggugcuguggaccucgaacuccaucgucguguucugcgggaccagcggcacguacgggaccggcuccuggccggacggggccgacaucaaccucaugcccaucuga

SEQ ID NO: 18431 - RNA, 1410 nt, Artificial Sequence
  derived and/or modified CDS sequence (AUadapt) from InfluenzaA__ABU92913__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacagcaucggguccuggucgaagaagauccuccggacgcaggaguccgagugcgucugcaucaacgggaccugcaccguggugaugaccgacggcucggccuccgggaaggcggacacgaagauccuguucaucaaggagggcaagaucguccacaccagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccgggacaaccgguccggcuacucggggaucuucuccgucgagggcaagagcugcaucaaccgcugcuucuacguggagcugauccggggccgcaaccaggagaccgaggugcucuggaccucgaacuccaucgucguguucugcgggaccagcggcacguacgggaccggcuccuggccggacggggccgacaucaaccugaugcccaucuga

SEQ ID NO: 18432 - RNA, 1413 nt, Artificial Sequence
  derived and/or modified CDS sequence (AUadapt) from InfluenzaA__ABV29560__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18433 - RNA, 1413 nt, Artificial Sequence; identical to SEQ ID NO: 18432
  derived and/or modified CDS sequence (AUadapt) from InfluenzaA__ABV29571__NA

SEQ ID NO: 18434 - RNA, 1413 nt, Artificial Sequence; identical to SEQ ID NO: 18432
  derived and/or modified CDS sequence (AUadapt) from InfluenzaA__ABV29582__NA

SEQ ID NO: 18435 - RNA, 1413 nt, Artificial Sequence; identical to SEQ ID NO: 18432
  derived and/or modified CDS sequence (AUadapt) from InfluenzaA__ABV29615__NA

SEQ ID NO: 18436 - RNA, 1413 nt, Artificial Sequence
  derived and/or modified CDS sequence (AUadapt) from InfluenzaA__ABV29637__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcaccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccaggugggcuacaucugcagcggcguguucggggacaacccccgccccaaggacggcaagggguccugcaacccgaugaccgucgacggcgccgacggggugaagggcuucucguacaaguacggcaacgggguguggaucggccggaccaaguccaacaagcugcgcaagggguucgagaugaucugggaccccaacggcuggaccgacacggacagcgacuucuccgucaagcaggacgugguggcgaucagcgacuggucgggguacuccggcagcuucguccagcaccccgagcucaccggccuggacugcauccggcccugcuucuggguggagcugguccgcgggcucccgcgggagaacaccaccaucuggacguccggcucguccaucagcuucugcgggguggacuccgacaccgccaacuggagcuggcccgacggcgccgagcugcccuucaccaucgacaaguga

SEQ ID NO: 18437 - RNA, 1413 nt, Artificial Sequence; identical to SEQ ID NO: 18432
  derived and/or modified CDS sequence (AUadapt) from InfluenzaA__ABV29648__NA

SEQ ID NO: 18438 - RNA, 1413 nt, Artificial Sequence; identical to SEQ ID NO: 18432
  derived and/or modified CDS sequence (AUadapt) from InfluenzaA__ABV29659__NA

SEQ ID NO: 18439 - RNA, 1413 nt, Artificial Sequence; identical to SEQ ID NO: 18432
  derived and/or modified CDS sequence (AUadapt) from InfluenzaA__ABV29670__NA

SEQ ID NO: 18440 - RNA, 1413 nt, Artificial Sequence
  derived and/or modified CDS sequence (AUadapt) from InfluenzaA__ABV29681__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggaucgacuccgacaccgccaacuggagcuggcccgacggcgccgagcugcccuucaccaucgacaaguga

SEQ ID NO: 18441 - RNA, 1413 nt, Artificial Sequence; identical to SEQ ID NO: 18432
  derived and/or modified CDS sequence (AUadapt) from InfluenzaA__ABV29692__NA

SEQ ID NO: 18442 - RNA, 1413 nt, Artificial Sequence; identical to SEQ ID NO: 18432
  derived and/or modified CDS sequence (AUadapt) from InfluenzaA__ABV29703__NA

SEQ ID NO: 18443 - RNA, 1410 nt, Artificial Sequence
  derived and/or modified CDS sequence (AUadapt) from InfluenzaA__ABV29714__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18444 - RNA, 1410 nt, Artificial Sequence
  derived and/or modified CDS sequence (AUadapt) from InfluenzaA__ABV29725__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggggaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacucgauccgccuguccgccgggggcgacaucugggugacccgggagcccuacgucagcugcgaccccgacaagugcuaccaguucgcccucgggcagggcacgacccugaacaacgugcacuccaacgacaccgugcgcgaccggaccccguaccgcacgcugcucaugaacgagcugggcguccccuuccaccuggggaccaagcaggucugcaucgccuggucguccagcuccugccacgacggcaaggccuggcuccacgugugcaucaccggggacgacaagaacgcgaccgccucguucaucuacaacggccggcugguggacuccaucgugagcugguccaaggagauccugcgcacgcaggagucggagugcgugugcaucaacgggaccugcaccgucgugaugaccgacggcuccgccagcggcaaggccgacacgaagauccucuucaucgaggaggggaagaucgugcacaccucgacccuguccggcagcgcgcagcacgucgaggagugcuccugcuucccccgguaccccggggugcgcugcgugugccgggacaacuggaagggcucgaaccgcccgaucgucgacaucaacaucaaggaccacuccaucgugagcuccuacgugugcucgggccuggucggggacacgccccggaagaacgacuccagcuccucgucccacugccucgaccccaacaacgaggagggcgggcacggcgugaaggggugggccuucgacgacggcaacgacguguggaugggccgcaccaucagcgagaagucccggcugggguacgagaccuucaaggucaucgagggcuggucgaaccccaaguccaagcugcagaucaaccgccaggugaucgucgaccgggggaaccgcagcggcuacuccgggaucuucucgguggagggcaagagcugcaucaaccggugcuucuacguggagcucauccgcggccggaaggaggagaccgagguccuguggaccuccaacucgaucgugguguucugcgggacguccggcaccuacgggaccggcagcuggccggacggggccgacaucaaccugaugcccaucuga

SEQ ID NO: 18445 - RNA, 1413 nt, Artificial Sequence
  derived and/or modified CDS sequence (AUadapt) from InfluenzaA__ABV29736__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacguggugaccgggaaggacaagaccucggucacccuggcgggcaacuccagccugugcuccaucucgggcugggccaucuacacgaaggacaacuccauccggaucgggagcaagggcgacguguucgugauccgcgagccguucaucuccugcucgcaccucgagugccggaccuucuuccugacccagggggcccugcucaacgacaagcacuccaacggcaccgucaaggaccgcagccccuaccgggcccugauguccugcccccugggggaggcccccucgccguacaacagcaaguucgaguccguggcguggagcgccuccgccugccacgacggcaugggcuggcucacgaucgggaucucgggccccgacaacggggccguggcgguccugaaguacaacggcaucaucaccgagaccaucaaguccuggaagaagcgcauccugcggacccaggagagcgagugcgugugcgugaacggcuccugcuucacgaucaugaccgacgggcccucggacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugaccgucgacggcgccgacggggugaagggcuucucguacaaguacggcaacgggguguggaucggccggaccaaguccaacaagcugcgcaagggguucgagaugaucugggaccccaacggcuggaccgacacggacaacgacuucagcgucaagcaggacgugguggcgaucaccgacugguccggguacucgggcagcuucguccagcaccccgagcucaccggccuggacugcauccggcccugcuucuggguggagcugguccgcgggcucccgcgggagaacaccacgaucuggaccuccggcucguccaucagcuucugcgggguggacuccgacaccgccaacuggagcuggcccgacggcgccgagcugcccuucaccaucgacaaguga

SEQ ID NO: 18446 - RNA, 1413 nt, Artificial Sequence
  derived and/or modified CDS sequence (AUadapt) from InfluenzaA__ABV29747__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcguccgccaggacgugguggccaucacggacuggucgggguacuccggcagcuucguccagcaccccgagcucaccggccuggacugcauccggcccugcuucuggguggagcugguccgcgggcucccgcgggagaacaccaccaucuggacguccggcucguccaucagcuucugcgggguggacuccgacaccgccaacuggagcuggcccgacggcgccgagcugcccuucaccaucgacaaguga

SEQ ID NO: 18447 - RNA, 1413 nt, Artificial Sequence; identical to SEQ ID NO: 18432
  derived and/or modified CDS sequence (AUadapt) from InfluenzaA__ABV29769__NA

SEQ ID NO: 18448 - RNA, 1413 nt, Artificial Sequence
  derived and/or modified CDS sequence (AUadapt) from InfluenzaA__ABV29780__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacguggugaccgggaaggacaagaccucggucacccuggcgggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcccccagcccguacaacucgaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcgcauccugcggacccaggagucggagugcgugugcgugaacggcuccugcuucacgaucaugaccgacgggcccagcgacggcgccgccuccuacaagaucuucaagaucgagaaggggaaggucaccaagucgaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugaccgucgacggcgccgacggggugaagggcuucagcuacaaguacggcaacgggguguggaucggccggaccaaguccagcaagcugcgcaagggguucgagaugaucugggaccccaacggcuggaccgacacggacaacgacuucuccgucaagcaggacgugguggcgaucaccgacuggucgggguacagcggcuccuucguccagcaccccgagcucaccggccuggacugcauccggcccugcuucuggguggagcugguccgcgggcucccgcgggagaacaccacgaucuggaccucgggcuccagcaucuccuucugcgggguggacagcgacaccgccaacugguccuggcccgacggcgccgagcugcccuucaccaucgacaaguga

SEQ ID NO: 18449 - RNA, 1413 nt, Artificial Sequence; identical to SEQ ID NO: 18432
  derived and/or modified CDS sequence (AUadapt) from InfluenzaA__ABV29791__NA

SEQ ID NO: 18450 - RNA, 1413 nt, Artificial Sequence; identical to SEQ ID NO: 18432
  derived and/or modified CDS sequence (AUadapt) from InfluenzaA__ABV29802__NA

SEQ ID NO: 18451 - RNA, 1410 nt, Artificial Sequence; identical to SEQ ID NO: 18286
  derived and/or modified CDS sequence (AUadapt) from InfluenzaA__ABV29824__NA

SEQ ID NO: 18452 - RNA, 1413 nt, Artificial Sequence; identical to SEQ ID NO: 18432
  derived and/or modified CDS sequence (AUadapt) from InfluenzaA__ABV29835__NA

SEQ ID NO: 18453 - RNA, 1413 nt, Artificial Sequence
  derived and/or modified CDS sequence (AUadapt) from InfluenzaA__ABV29846__NA
augaaccccaaccagaagaucaucaccaucggcucgaucuccaucgccaucgggaucaucagccugaugcuccagaucggcaacaucaucuccaucugggccucgcacuccauccagaucgggagccagaaccacaccggcaucugcaaccagcgcaucaucacguacgagaacuccaccugggugaaccacaccuacgucaacaucaacaacaccaacgugguggcggggaaggacaagacgagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccucgaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugaccgucgacggcgcggacggggugaagggcuucagcuacaaguacggcaacgggguguggaucggccggacgaaguccaacaagcugcgcaagggguucgagaugaucugggaccccaacggcuggaccgacaccgacucggacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccucgggcuccagcaucuccuucugcgggguggacagcgacacggccaacugguccuggcccgacggcgccgagcugcccuucaccaucgacaaguga

SEQ ID NO: 18454 - RNA, 1413 nt, Artificial Sequence
  derived and/or modified CDS sequence (AUadapt) from InfluenzaA__ABV29879__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucaucauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucggucgccugguccgccagcgccugccacgacggcaugggcuggcucaccaucgggaucuccggccccgacaacggggcgguggccgugcugaaguacaacggcaucaucacggagaccaucaagucguggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccaucgagcucaacgcccccaacuuccacuacgaggagugcucgugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggucgugcaacccggugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18455 - RNA, 1413 nt, Artificial Sequence; identical to SEQ ID NO: 18432
  derived and/or modified CDS sequence (AUadapt) from InfluenzaA__ABV29890__NA

SEQ ID NO: 18456 - RNA, 1410 nt, Artificial Sequence; identical to SEQ ID NO: 18286
  derived and/or modified CDS sequence (AUadapt) from InfluenzaA__ABV29901__NA

SEQ ID NO: 18457 - RNA, 1410 nt, Artificial Sequence
  derived and/or modified CDS sequence (AUadapt) from InfluenzaA__ABV29912__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggacauccugcggacccaggagucggagugcaucugcaucaacggcacgugcaccguggugaugaccgacggguccgccagcggcaaggccgacaccaagauccucuucaucgaggagggcaagaucguccacacgagcacccuguccgggucggcgcagcacguggaggagugcuccugcuacccccgcuaccccggcgugcggugcgucugccgcgacaacuggaaggggagcaaccggccgaucguggacaucaacaucaaggacuacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccggcaggucaucguggacaagggcaaccgcuccggguacagcggcaucuucuccguggagggcaagucgugcaucaaccggugcuucuacgucgagcugauccgcgggcggaaggaggagaccgaggugcuguggaccagcaacuccaucguggucuucugcggcaccagcgggacguacggcaccggguccuggccggacggcgccgacaucaaccucaugcccaucuga

SEQ ID NO: 18458 - RNA, 1413 nt, Artificial Sequence
  derived and/or modified CDS sequence (AUadapt) from InfluenzaA__ABV29923__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacgccaccaucuggaccucgggcuccagcaucuccuucugcgggguggacagcgacacggccaacugguccuggcccgacggcgccgagcugcccuucaccaucgacaaguga

SEQ ID NO: 18459 - RNA, 1410 nt, Artificial Sequence
  derived and/or modified CDS sequence (AUadapt) from InfluenzaA__ABV29934__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcaccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgacaucaaccugaugcccaucuga

SEQ ID NO: 18460 - RNA, 1413 nt, Artificial Sequence; identical to SEQ ID NO: 18445
  derived and/or modified CDS sequence (AUadapt) from InfluenzaA__ABV29945__NA

SEQ ID NO: 18461 - RNA, 1413 nt, Artificial Sequence
  derived and/or modified CDS sequence (AUadapt) from InfluenzaA__ABV29956__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaagggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18462 - RNA, 1413 nt, Artificial Sequence
  derived and/or modified CDS sequence (AUadapt) from InfluenzaA__ABV29989__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugaugcgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18463 - RNA, 1413 nt, Artificial Sequence; identical to SEQ ID NO: 18432
  derived and/or modified CDS sequence (AUadapt) from InfluenzaA__ABV30000__NA

SEQ ID NO: 18464 - RNA, 1413 nt, Artificial Sequence; identical to SEQ ID NO: 18432
  derived and/or modified CDS sequence (AUadapt) from InfluenzaA__ABV30011__NA

SEQ ID NO: 18465 - RNA, 1413 nt, Artificial Sequence; identical to SEQ ID NO: 18432
  derived and/or modified CDS sequence (AUadapt) from InfluenzaA__ABV30022__NA

SEQ ID NO: 18466 - RNA, 1413 nt, Artificial Sequence
  derived and/or modified CDS sequence (AUadapt) from InfluenzaA__ABV30044__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucgggcacccuggccggcaacuccagccugugcuccaucucggggugggccaucuacaccaaggacaacuccauccggaucggcagcaagggggacgucuucgugauccgcgagccguucaucuccugcucgcaccucgagugccggacguucuuccugacccagggcgcccugcucaacgacaagcacuccaacgggaccgugaaggaccgcagccccuaccgggcccugauguccugcccccugggcgaggcgcccucgccguacaacagcaaguucgaguccgucgccuggagcgccuccgccugccacgacggcaugggguggcucaccaucggcaucucggggcccgacaacggcgcgguggccgugcugaaguacaacggcaucaucacggagaccaucaaguccuggaagaagcgcauccugcggacccaggagagcgagugcgucugcgugaacggguccugcuucaccaucaugacggacggccccucgaacggggccgccuccuacaagaucuucaagaucgagaagggcaaggugaccaagagcaucgagcucaacgcccccaacuuccacuacgaggagugcuccugcuacccggacaccgggaccgucaugugcgugugccgcgacaacuggcacggcucgaaccggcccuggguguccuucaaccagaaccuggacuaccaggucggcuacaucugcagcgggguguucggcgacaacccccgccccaaggacgggaagggcuccugcaacccgaugacgguggacggggcggacggcgucaagggcuucucguacaaguacgggaacggcguguggaucgggcggaccaaguccaacaagcugcgcaagggcuucgagaugaucugggaccccaacggguggaccgacaccgacagcgacuucuccgugaagcaggacgucguggccaucacggacuggucgggcuacagcggcuccuucgugcagcaccccgagcucaccgggcuggacugcauccggcccugcuucugggucgagcuggugcgcggccucccgcgggagaacaccaccaucuggacgucgggguccagcaucuccuucugcggcgucgacagcgacaccgccaacugguccuggcccgacggcgccgagcugcccuucaccaucgacaaguga

SEQ ID NO: 18467 - RNA, 1413 nt, Artificial Sequence
  derived and/or modified CDS sequence (AUadapt) from InfluenzaA__ABV30055__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 18468 - RNA, 1410 nt, Artificial Sequence
  derived and/or modified CDS sequence (AUadapt) from InfluenzaA__ABV30077__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 18469 - RNA, 1413 nt, Artificial Sequence; identical to SEQ ID NO: 18432
  derived and/or modified CDS sequence (AUadapt) from InfluenzaA__ABV30088__NA

SEQ ID NO: 18470 - RNA, 1413 nt, Artificial Sequence; identical to SEQ ID NO: 18432
  derived and/or modified CDS sequence (AUadapt) from InfluenzaA__ABV30099__NA

SEQ ID NO: 18471 - RNA, 1413 nt, Artificial Sequence
  derived and/or modified CDS sequence (AUadapt) from InfluenzaA__ABV30110__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagucguggaagaagcgcauccugcggacccaggaguccgagugcgugugcgugaacgggagcugcuucaccaucaugacggacggccccuccaacggggccgccagcuacaagaucuucaagaucgagaagggcaaggucaccaaguccaucgagcucaacgcccccaacuuccacuacgaggagugcucgugcuacccggacaccgggaccgugaugugcgugugccgcgacaacuggcacggcuccaaccggcccugggucagcuucaaccagaaccuggacuaccagaucggcuacaucugcuccgggguguucggcgacaacccccgccccaaggacgggaagggcucgugcaacccggugacggucgacggggcggacggcgugaagggcuucuccuacaaguacgggaacggcguguggaucgggcggaccaagagcaaccgccugcggaagggcuucgagaugaucugggaccccaacggguggaccgacaccgacuccgacuucagcgucaagcaggacgugguggccaucacggacuggucgggcuacuccggcagcuucguccagcaccccgagcucaccgggcuggacugcauccgccccugcuucuggguggagcugguccggggccucccgcgcgagaacaccaccaucuggacguccgggucguccaucagcuucugcggcguggacuccgacaccgccaacuggagcuggcccgacggcgccgagcugcccuucaccaucgacaaguga

SEQ ID NO: 18472 - RNA, 1413 nt, Artificial Sequence; identical to SEQ ID NO: 18432
  derived and/or modified CDS sequence (AUadapt) from InfluenzaA__ABV30132__NA

SEQ ID NO: 18473 - RNA, 1413 nt, Artificial Sequence
  derived and/or modified CDS sequence (AUadapt) from InfluenzaA__ABV30143__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18474 - RNA, 1413 nt, Artificial Sequence; identical to SEQ ID NO: 18458
  derived and/or modified CDS sequence (AUadapt) from InfluenzaA__ABV30154__NA

SEQ ID NO: 18475 - RNA, 1413 nt, Artificial Sequence
  derived and/or modified CDS sequence (AUadapt) from InfluenzaA__ABV30165__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaaccugucgcucugcuccaucagcggcugggccaucuacaccaaggacaacuccauccggaucgggucgaagggcgacguguucgugauccgcgagccguucaucuccugcagccaccuggagugccggacguucuuccugacccagggggcccuccugaacgacaagcacuccaacggcaccgucaaggaccgcagccccuaccgggcccugauguccugcccccucggggaggcgcccucgccguacaacagcaaguucgaguccguggccuggagcgccuccgccugccacgacggcaugggcuggcugaccaucgggaucucgggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccucgaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacucggacuucuccgucaagcaggacgugguggccaucacggacuggagcggguacagcggcuccuucguccagcaccccgagcugaccggccuggacugcauccgccccugcuucuggguggagcucguccgggggcugccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18476 - RNA, 1413 nt, Artificial Sequence; identical to SEQ ID NO: 18432
  derived and/or modified CDS sequence (AUadapt) from InfluenzaA__ABV30187__NA

SEQ ID NO: 18477 - RNA, 1413 nt, Artificial Sequence; identical to SEQ ID NO: 18432
  derived and/or modified CDS sequence (AUadapt) from InfluenzaA__ABV30198__NA

SEQ ID NO: 18478 - RNA, 1410 nt, Artificial Sequence; identical to SEQ ID NO: 18286
  derived and/or modified CDS sequence (AUadapt) from InfluenzaA__ABV30209__NA

SEQ ID NO: 18479 - RNA, 1410 nt, Artificial Sequence; identical to SEQ ID NO: 18468
  derived and/or modified CDS sequence (AUadapt) from InfluenzaA__ABV30220__NA

SEQ ID NO: 18480 - RNA, 1410 nt, Artificial Sequence; identical to SEQ ID NO: 18468
  derived and/or modified CDS sequence (AUadapt) from InfluenzaA__ABV30231__NA

SEQ ID NO: 18481 - RNA, 1410 nt, Artificial Sequence
  derived and/or modified CDS sequence (AUadapt) from InfluenzaA__ABV30264__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagguggucuaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggugacccgggagcccuacguguccugcgaccccgacaagugcuaccaguucgcccucggccaggggaccacgcugaacaacguccacagcaacgacaccgugcacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccuggucgacagcaucguguccuggucgaaggagauccugcggacccaggaguccgagugcgugugcaucaacggcacgugcaccgucgugaugaccgacgggagcgccucgggcaaggccgacaccaagauccucuucaucgaggagggcaagaucgugcacacguccacccugagcggguccgcgcagcacgucgaggagugcucgugcuacccccgcuaccccggcgugcggugcgugugccgcgacaacuggaagggguccaaccggccgaucgucgacaucaacaucaaggacuacagcaucgugucccgcuacgugugcucgggccuggucggcgacacgccccggaagaacgacuccagcuccagcucccacugccucgaccccaacaacgaggagggcgggcacggggugaagggcugggccuucgacgacgggaacgacgucuggaugggccgcaccaucucggagaagucccggagcggcuacgagaccuucaaggugaucgaggggugguccaaccccaacucgaagcugcagaucaaccgccaggugaucgucgaccggggcaaccgcuccggguacagcggcaucuucucgguggaggggaaguccugcaucaaccggugcuucuacguggagcugauccgcggccggaaggaggagaccgagguccucuggaccagcaacuccaucgugguguucugcggcaccagcgggacguacggcaccggguccuggccggacggcgccgacaucaaccugaugcccaucuga

SEQ ID NO: 18482 - RNA, 1410 nt, Artificial Sequence
  derived and/or modified CDS sequence (AUadapt) from InfluenzaA__ABV30275__NA
augaaccccaaccagaagaucaucaccaucggcucggugucccugaccaucucgacgaucugcuucuucaugcagaccgccauccucaucaccaccgucacgcugcacuucaagcaguacgaguucaacuccaccccgaacaaccaggugaugcugugcgagcccaccaucaucgagcgcaacaucaccgagaucguguaccucacgaacaccaccaucgagaaggagaucugccccaagcuggccgaguaccggaacuggagcaagccccagugcgacaucaccggguucgcgccguucuccaaggacaacucgauccgccuguccgccggcggggacaucugggucacgcgggagcccuacgugagcugcgaccccgacaagugcuaccaguucgcccucggccaggggaccacccugaacaacgugcacuccaacgacaccguccgcgaccggacgcccuaccgcacccugcucaugaacgagcugggcgugccguuccaccugggcaccaagcaggucugcaucgccuggucguccagcuccugccacgacgggaaggccuggcuccacgugugcaucaccggcgacgacaagaacgcgacggccucguucaucuacaacgggcggcugguggacuccaucgugagcugguccaaggagauccugcgcacccaggagucggagugcgucugcaucaacgggaccugcaccguggugaugacggacggguccgccagcggcaaggccgacaccaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgccccaucguggacaucaacaucaaggaccacuccaucgugagcuccuacgucugcucgggccuggugggcgacacgccgcggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggacguccaacucgaucguggucuucugcggcaccuccgggaccuacggcaccgggagcuggcccgacggcgccgacaucaaccugaugccgaucuga

SEQ ID NO: 18483 - RNA, 1413 nt, Artificial Sequence; identical to SEQ ID NO: 18473
  derived and/or modified CDS sequence (AUadapt) from InfluenzaA__ABV30297__NA

SEQ ID NO: 18484 - RNA, 1413 nt, Artificial Sequence
  derived and/or modified CDS sequence (AUadapt) from InfluenzaA__ABV30308__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugccucaacggcagcugcuucaccaucaugacggacgggcccuccaacggcgccgccagcuacaagaucuucaagaucgagaaggggaaggugaccaaguccaucgagcugaacgcccccaacuuccacuacgaggagugcucgugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggucgugcaacccggugacgguggacggcgcggacggggucaagggcuucuccuacaaguacggcaacgggguguggaucggccggaccaagagcaaccgccuccggaagggguucgagaugaucugggaccccaacggcuggaccgacaccgacuccgacuucagcgugaagcaggacgucguggccaucacggacuggucgggguacuccggcagcuucgugcagcaccccgagcugaccggccuggacugcauccgccccugcuucugggucgagcucgugcgggggcugccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18485 - RNA, 1413 nt, Artificial Sequence
  derived and/or modified CDS sequence (AUadapt) from InfluenzaA__ABV30319__NA
augaaccccaaccagaagaucaucaccaucggcucgaucuccaucgccaucgggaucaucagccugaugcuccagaucggcaacaucguguccaucugggccucgcacuccauccagaccgggagccagaaccacacgggcaucugcaaccagcgcaucaucaccuacgagaacuccaccugggucaaccacaccuacgugucgaucaacaacacgaacguggucgcggggaaggacaagaccuccgugacccuggccggcaacagcucccugugcagcaucuccggcugggccaucuacaccaaggacaacucgauccggaucggguccaagggcgacguguucgucauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcggucgccgugcugaaguacaacggcaucaucacggagaccaucaagucguggaagaagcgcauccugcggacccaggaguccgagugcgugugcgucaacggcagcugcuucaccaucaugacggacgggcccuccaacggcgccgccagcuacaagaucuucaagaucgagaaggggaaggugaccaaguccaucgagcucaacgcccccaacuuccacuacgaggagugcucgugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggucgugcaacccggucacgguggacggcgcggacggggugaagggcuucuccuacaaguacggcaacggggucuggaucggccggaccaagagcaaccgccugcggaagggguucgagaugaucugggaccccaacggcuggaccgacaccgacuccgacuucagcgugaagcaggacguggucgccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18486 - RNA, 1413 nt, Artificial Sequence; identical to SEQ ID NO: 18473
  derived and/or modified CDS sequence (AUadapt) from InfluenzaA__ABV30330__NA

SEQ ID NO: 18487 - RNA, 1413 nt, Artificial Sequence; identical to SEQ ID NO: 18432
  derived and/or modified CDS sequence (AUadapt) from InfluenzaA__ABV30341__NA

SEQ ID NO: 18488 - RNA, 1413 nt, Artificial Sequence; identical to SEQ ID NO: 18432
  derived and/or modified CDS sequence (AUadapt) from InfluenzaA__ABV30363__NA

SEQ ID NO: 18489 - RNA, 1413 nt, Artificial Sequence; identical to SEQ ID NO: 18432
  derived and/or modified CDS sequence (AUadapt) from InfluenzaA__ABV30374__NA

SEQ ID NO: 18490 - RNA, 1410 nt, Artificial Sequence
  derived and/or modified CDS sequence (AUadapt) from InfluenzaA__ABV30385__NA
augaaccccaaccagaagaucaucaccaucggcucggugucccugaccaucagcacgaucugcuucuucaugcagaucgccauccucaucaccaccgucacccugcacuucaagcaguacgaguucuccccgccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuacccgggcguccggugcgugugccgcgacaacuggaaggggagcaaccggcccaucguggacaucaacaucaaggacuacuccaucgucucgcgcuacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggucgggcuacgagaccuucaaggucaucgagggguggagcaacccgaacuccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggcccgacggcgccgacaucaaccugaugcccaucuga

SEQ ID NO: 18491 - RNA, 1410 nt, Artificial Sequence
  derived and/or modified CDS sequence (AUadapt) from InfluenzaA__ABV30396__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuguccgaguaccggaacuggagcaagccccagugcaacaucaccggguucgccccguucuccaaggacaacagcauccgccuguccgcgggcggggacaucugggucacccgggagcccuacgugucgugcgaccccgacaagugcuaccaguucgcccucggccaggggaccacgcugaacaacgugcacuccaacgacaccguccacgaccgcacccccuaccggacccugcucaugaacgagcugggcgugccguuccaccugggcacgaagcaggucugcaucgccuggagcuccucguccugccacgacgggaaggccuggcuccacgugugcgugaccggcgacgacaagaacgccaccgcgagcuucaucuacaacgggcgccugguggacuccaucgucagcugguccaaggagauccugcggacccaggagucggagugcgugugcaucaacggcacgugcaccguggucaugaccgacgggagcgccuccggcaaggccgacaccaagauccucuucaucgaggagggcaagaucgugcacacgagcacccuguccgggucggcccagcacguggaggagugcuccugcuacccccgcuaccccggcguccggugcgugugccgcgacaacuggaaggggagcaaccggcccaucguggacaucaacaucaaggacuacuccaucgucucguccuacgugugcagcggccuggugggcgacaccccgcgcaagaacgacuccagcuccucgucccacugccucgaccccaacaacgaggagggcgggcacggggucaagggcugggcguucgacgacgggaacgacguguggaugggccggaccaucagcgagaagcugcgcuccggcuacgagacguucaaggucaucgagggguggucgaaccccaacuccaagcugcagaucaaccgccaggugaucguggaccggggcaaccggagcggguacagcggcaucuucuccgucgagggcaagucgugcaucaaccgcugcuucuacguggagcucauccgggggcgcaaggaggagaacgaggugcuguggaccuccaacagcaucgucguguucugcggcaccuccgggaccuacggcacggggagcuggcccgacggcgccgacaucaaccugaugccgaucuga

SEQ ID NO: 18492 - RNA, 1410 nt, Artificial Sequence
  derived and/or modified CDS sequence (AUadapt) from InfluenzaA__ABV30407__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggaccagcggcacguacgggaccggcuccuggccggacggggccgacaucaaccugaugcccaucuga

SEQ ID NO: 18493 - RNA, 1410 nt, Artificial Sequence
  derived and/or modified CDS sequence (AUadapt) from InfluenzaA__ABV30418__NA
augaaccccaaccagaagaucaucaccaucggcucggugucccugaccaucagcacgaucugcuucuucaugcagaucgccauccucaucaccaccgucacccugcacuucaagcaguacgaguucuccucgcugccgaacaaccaggugaugcucugcgagcccacgaucaucgagcgcaacaucaccgagaucguguaccugaccaacaccacgaucgagaaggagaucugccccaagcuggccgaguaccggaacugguccaagccccagugcgacaucaccggguucgcgccguucagcaaggacaacuccauccgccucagcgccggcggggacaucugggucacccgggagcccuacguguccugcgaccccgacaagugcuaccaguucgcccugggccaggggaccacgcugaacaacgugcacucgaacgacaccguccacgaccgcacccccuaccggacccuccugaugaacgagcugggcgugccguuccaccucggcacgaagcaggucugcaucgccugguccagcuccucgugccacgacgggaaggccuggcugcacgugugcgugaccggcgacgacaagaacgcgaccgccuccuucaucuacaacgggcgccugguggacagcaucgucuccuggagcaaggagauccuccggacccaggaguccgagugcgugugcaucaacggcacgugcaccguggucaugaccgacgggucggccagcggcaaggccgacaccaagauccuguucaucgaggagggcaagaucgugcacacguccacccugucgggguccgcgcagcacguggaggagugcagcugcuacccccgcuaccccggcguccggugcgugugccgcgacaacuggaagggguccaaccggcccaucguggacaucaacaucaaggacuacagcaucgucucccgcuacgugugcucgggccucgugggcgacaccccgcggaagaacgacuccagcuccucgucccacugccuggaccccaacaacgaggagggcgggcacggggucaagggcugggccuucgacgacgggaacgacguguggaugggccgcaccaucagcgagaagucccggagcggcuacgagacguucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcucauccgcggccggcgcgaggagaccgaggugcuguggaccagcaacuccaucgucguguucugcggcaccagcgggacguacggcaccggguccuggcccgacggcgccgacaucaaccugaugccgaucuga

SEQ ID NO: 18494 - RNA, 1410 nt, Artificial Sequence; identical to SEQ ID NO: 18459
  derived and/or modified CDS sequence (AUadapt) from InfluenzaA__ABV30429__NA

SEQ ID NO: 18495 - RNA, 1410 nt, Artificial Sequence; identical to SEQ ID NO: 18459
  derived and/or modified CDS sequence (AUadapt) from InfluenzaA__ABV30440__NA

SEQ ID NO: 18496 - RNA, 1410 nt, Artificial Sequence; identical to SEQ ID NO: 18459
  derived and/or modified CDS sequence (AUadapt) from InfluenzaA__ABV30451__NA

SEQ ID NO: 18497 - RNA, 1413 nt, Artificial Sequence; identical to SEQ ID NO: 18432
  derived and/or modified CDS sequence (AUadapt) from InfluenzaA__ABV30462__NA

SEQ ID NO: 18498 - RNA, 1410 nt, Artificial Sequence; identical to SEQ ID NO: 18459
  derived and/or modified CDS sequence (AUadapt) from InfluenzaA__ABV30473__NA

SEQ ID NO: 18499 - RNA, 1410 nt, Artificial Sequence
  derived and/or modified CDS sequence (AUadapt) from InfluenzaA__ABV30484__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucgcgcuacgugugcuccggccuggugggcgacacgccccggaagaacgacagcuccucgaacucccacugccucgaccccaacaacgaggagggcgggcacggggucaagggcugggccuucgacgacgggaacgacguguggaugggccgcaccaucagcgagaagucccggucgggcuacgagaccuucaaggucaucgaggggugguccaaccccaacagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcaccagcgggacguacggcaccggguccuggccggacggcgccgacaucaaccugaugcccaucuga

SEQ ID NO: 18500 - RNA, 1413 nt, Artificial Sequence; identical to SEQ ID NO: 18471
  derived and/or modified CDS sequence (AUadapt) from InfluenzaA__ABV30495__NA

SEQ ID NO: 18501 - RNA, 1413 nt, Artificial Sequence; identical to SEQ ID NO: 18432
  derived and/or modified CDS sequence (AUadapt) from InfluenzaA__ABV30506__NA

SEQ ID NO: 18502 - RNA, 1410 nt, Artificial Sequence; identical to SEQ ID NO: 18468
  derived and/or modified CDS sequence (AUadapt) from InfluenzaA__ABV30517__NA

SEQ ID NO: 18503 - RNA, 1413 nt, Artificial Sequence
  derived and/or modified CDS sequence (AUadapt) from InfluenzaA__ABV30528__NA
augaacucgaaccagaagaucaucaccaucggcuccaucagcaucgccaucgggaucaucucccugaugcuccagaucggcaacaucaucucgaugugggccucccacagcauccagaccgggucccagaaccacacgggcaucugcaaccagcgcaucaucaccuacgagaacucgaccugggugaaccacaccuacgucaacaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagcccuucaucagcugcucccaccucgagugccggacguucuuccugacccagggggcccugcucaacgacaagcacucgaacggcaccgucaaggaccgcuccccguaccgggcccugaugagcugcccccugggggaggcgcccagccccuacaacuccaaguucgagucgguggccugguccgccagcgccugccacgacggcaugggcuggcucaccaucgggaucuccggcccggacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuaccccgacaccggcaccgugaugugcgugugccgcgacaacuggcacggguccaaccggccgugggucagcuucaaccagaaccuggacuaccaggugggcuacaucugcuccggcguguucggggacaacccccgccccaaggacggcaaggggucgugcaaccccaugacggucgacggcgcggacggggugaagggcuucuccuacaaguacggcaacgggguguggaucggccggaccaagagcaacaagcugcgcaagggguucgagaugaucugggacccgaacggcuggaccgacaccgacuccgacuucagcgucaagcaggacgugguggccaucacggacuggucgggguacuccggcagcuucguccagcaccccgagcucaccggccuggacugcauccggcccugcuucuggguggagcugguccgcgggcucccccgggagaacgccaccaucuggaccuccggcucguccaucagcuucugcgggguggacuccgacacggccaacuggagcuggccggacggcgccgagcugcccuucaccaucgacaaguga

SEQ ID NO: 18504 - RNA, 1413 nt, Artificial Sequence; identical to SEQ ID NO: 18432
  derived and/or modified CDS sequence (AUadapt) from InfluenzaA__ABV30539__NA

SEQ ID NO: 18505 - RNA, 1413 nt, Artificial Sequence; identical to SEQ ID NO: 18432
  derived and/or modified CDS sequence (AUadapt) from InfluenzaA__ABV30561__NA

SEQ ID NO: 18506 - RNA, 1413 nt, Artificial Sequence; identical to SEQ ID NO: 18432
  derived and/or modified CDS sequence (AUadapt) from InfluenzaA__ABV30572__NA

SEQ ID NO: 18507 - RNA, 1413 nt, Artificial Sequence; identical to SEQ ID NO: 18432
  derived and/or modified CDS sequence (AUadapt) from InfluenzaA__ABV30583__NA

SEQ ID NO: 18508 - RNA, 1413 nt, Artificial Sequence; identical to SEQ ID NO: 18432
  derived and/or modified CDS sequence (AUadapt) from InfluenzaA__ABV30594__NA

SEQ ID NO: 18509 - RNA, 1413 nt, Artificial Sequence
  derived and/or modified CDS sequence (AUadapt) from InfluenzaA__ABV30605__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggucgggaaggacaagaccuccgugacccuggcgggcaacucgucccugugcagcaucuccggcugggccaucuacaccaaggacaacagcauccggaucggguccaagggcgacguguucgucauccgcgagccguucaucucgugcucccaccucgagugccggacguucuuccugacccagggggcccugcucaacgacaagcacagcaacggcaccgugaaggaccgcucccccuaccgggcccugaugucgugcccccugggggaggcccccagcccguacaacuccaaguucgagagcguggcgugguccgccucggccugccacgacggcaugggcuggcucaccaucgggaucuccggccccgacaacggggccgucgcggugcugaaguacaacggcaucaucacggagaccaucaagagcuggaagaagcgcauccugcggacccaggaguccgagugcgugugcgucaacggcagcugcuucaccaucaugacggacgggcccuccaacggcgccgccucguacaagaucuucaagaucgagaaggggaaggugaccaaguccaucgagcucaacgcccccaacuuccacuacgaggagugcagcugcuacccggacaccggcaccgugaugugcgucugccgcgacaacuggcacggguccaaccggcccugggugucguucaaccagaaccuggacuaccagaucggcuacaucugcuccggcguguucggggacaacccccgccccaaggacggcaaggggagcugcaacccggucacgguggacggcgccgacggggugaagggcuucuccuacaaguacggcaacggggucuggaucggccggaccaagagcaaccgccugcggaagggguucgagaugaucugggaccccaacggcuggaccgacaccgacuccgacuucucggugaagcaggacguggucgcgaucacggacuggagcggguacuccggcagcuucgugcagcaccccgagcucaccggccuggacugcauccgccccugcuucugggucgagcuggugcgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18510 - RNA, 1413 nt, Artificial Sequence; identical to SEQ ID NO: 18432
  derived and/or modified CDS sequence (AUadapt) from InfluenzaA__ABV30616__NA

SEQ ID NO: 18511 - RNA, 1413 nt, Artificial Sequence; identical to SEQ ID NO: 18432
  derived and/or modified CDS sequence (AUadapt) from InfluenzaA__ABV30627__NA

SEQ ID NO: 18512 - RNA, 1410 nt, Artificial Sequence
  derived and/or modified CDS sequence (AUadapt) from InfluenzaA__ABV30649__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaacgccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18513 - RNA, 1410 nt, Artificial Sequence; identical to SEQ ID NO: 18286
  derived and/or modified CDS sequence (AUadapt) from InfluenzaA__ABV30660__NA

SEQ ID NO: 18514 - RNA, 1413 nt, Artificial Sequence
  derived and/or modified CDS sequence (AUadapt) from InfluenzaA__ABV45852__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccaacaacggcgccgccucguacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcgaggggagcugcaacccggugacggucgacggcgcggacggggugaagggcuucuccuacaaguacggcaacgggguguggaucggccggaccaagucgaaccgccugcggaagggguucgagaugaucugggaccccaacggcuggaccgacaccgacuccaacuucagcgucaagcaggacgugguggccaucacggacugguccggguacucgggcagcuucguccagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 18515 - RNA, 1410 nt, Artificial Sequence; identical to SEQ ID NO: 18286
  derived and/or modified CDS sequence (AUadapt) from InfluenzaA__ABV45863__NA

SEQ ID NO: 18516 - RNA, 1413 nt, Artificial Sequence
  derived and/or modified CDS sequence (AUadapt) from InfluenzaA__ABV45874__NA
augaaccccaaccagaagaucaucaccaucggcucgaucuccaucgccaucgggaucaucagccugaugcuccagaucggcaacaucaucuccaucugggccucguacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccucguacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucucggucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18517 - RNA, 1413 nt, Artificial Sequence; identical to SEQ ID NO: 18432
  derived and/or modified CDS sequence (AUadapt) from InfluenzaA__ABV45885__NA

SEQ ID NO: 18518 - RNA, 1413 nt, Artificial Sequence; identical to SEQ ID NO: 18445
  derived and/or modified CDS sequence (AUadapt) from InfluenzaA__ABV45896__NA

SEQ ID NO: 18519 - RNA, 1413 nt, Artificial Sequence; identical to SEQ ID NO: 18432
  derived and/or modified CDS sequence (AUadapt) from InfluenzaA__ABV45918__NA

SEQ ID NO: 18520 - RNA, 1413 nt, Artificial Sequence
  derived and/or modified CDS sequence (AUadapt) from InfluenzaA__ABV45929__NA
augaaccccaaccagaagaucaucaccaucggcucgaucuccaucgccaucgggaucaucagccugaugcuccagaucggcaacaucaucuccaugugggccucgcacuccauccagaccgggagccagaaccacacgggcaucugcaaccagcgcaucaucaccuacgagaacuccaccugggugaaccacaccuacgucaacaucaacaacacgaacguggugaccgggaaggacaagaccucggucacccuggcgggcaacuccagccugugcuccaucucgggcugggccaucuacacgaaggacaacuccauccggaucgggagcaagggcgacguguucgugauccgcgagccguucaucuccugcucgcaccucgagugccggaccuucuuccugacccagggggcccugcucaacgacaagcacuccaacggcaccgucaaggaccgcagccccuaccgggcccugauguccugcccccugggggaggcccccucgccguacaacagcaaguucgaguccguggcguggagcgccuccgccugccacgacggcaugggcuggcucacgaucgggaucucgggccccgacaacggggccguggcgguccugaaguacaacggcaucaucaccgagaccaucaaguccuggaagaagcgcauccugcggacccaggagagcgagugcgugugcgugaacggcuccugcuucacgaucaugaccgacgggcccucggacggcgccgccuccuacaagaucuucaagaucgagaaggggaaggucaccaagagcaucgagcucaacgcccccaacuuccacuacgaggagugcuccugcuacccggacaccggcacggugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugaccgucgacggcgccgacggggugaagggcuucucguacaaguacggcaacgggguguggaucggccggaccaaguccaacaagcugcgcaagggguucgagaugaucugggaccccaacggcuggaccgacacggacaacgacuucagcgucaagcaggacgugguggcgaucaccgacugguccggguacucgggcagcuucguccagcaccccgagcucaccggccuggacugcauccggcccugcuucuggguggagcugguccgcgggcucccgcgggagaacgccaccaucuggacguccggcucguccaucagcuucugcgggguggacuccgacaccgccaacuggagcuggcccgacggcgccgagcugcccuucaccaucgacaaguga

SEQ ID NO: 18521 - RNA, 1413 nt, Artificial Sequence
  derived and/or modified CDS sequence (AUadapt) from InfluenzaA__ABV45940__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucauccgguacgagaacuccaccugggugaaccacaccuacgucaacaucaacaacaccaacgugguggcggggaaggacaagacgucggucacccuggccggcaacuccagccugugcuccaucagcggcugggccaucuacaccaaggacaacuccauccgcaucgggucgaagggcgacguguucgugauccgggagccguucaucuccugcagccaccucgagugccgcaccuucuuccugacgcagggggcccugcucaacgacaagcacuccaacggcaccgucaaggaccggucgcccuaccgcgcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucaccgagacgaucaaguccuggaagaagcagauccugcggacccaggagucggagugcgugugcgugaacggcuccugcuucaccaucaugaccgacgggcccagcaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggucgaaccggcccugggucuccuucaaccagagccuggacuaccaggugggcuacaucugcuccggcguguucggggacaacccccgccccaaggacggcaaggggucgugcaacccgaugaccgucgacggcgcggacggggugaagggcuucuccuacaaguacggcaacgggguguggaucggccggaccaagagcaacaagcugcgcaagggguucgagaugaucugggaccccaacggcuggacggacaccgacuccgacuucagcgucaagcaggacgugguggccaucaccgacuggucgggguacuccggcagcuucguccagcaccccgagcucacgggccuggacugcauccggcccugcuucuggguggagcugguccgcgggcucccgcgggagaacaccaccaucuggaccuccggcucguccaucagcuucugcgggguggacuccgacacggccaacuggagcuggcccgacggcgccgagcugcccuucaccaucgacaaguga

SEQ ID NO: 18522 - RNA, 1413 nt, Artificial Sequence; identical to SEQ ID NO: 18458
  derived and/or modified CDS sequence (AUadapt) from InfluenzaA__ABV45951__NA

SEQ ID NO: 18523 - RNA, 1410 nt, Artificial Sequence
  derived and/or modified CDS sequence (AUadapt) from InfluenzaA__ABV45973__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgacgugcuguggaccuccaacagcaucguggucuucugcggcaccuccgggacguacggcaccgggagcuggccggacggcgccgacaucaaccugaugcccaucuga

SEQ ID NO: 18524 - RNA, 1410 nt, Artificial Sequence
  derived and/or modified CDS sequence (AUadapt) from InfluenzaA__ABV45984__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 18525 - RNA, 1410 nt, Artificial Sequence; identical to SEQ ID NO: 18286
  derived and/or modified CDS sequence (AUadapt) from InfluenzaA__ABV45995__NA

SEQ ID NO: 18526 - RNA, 1413 nt, Artificial Sequence; identical to SEQ ID NO: 18445
  derived and/or modified CDS sequence (AUadapt) from InfluenzaA__ABV82554__NA

SEQ ID NO: 18527 - RNA, 1410 nt, Artificial Sequence; identical to SEQ ID NO: 18468
  derived and/or modified CDS sequence (AUadapt) from InfluenzaA__ABV82565__NA

SEQ ID NO: 18528 - RNA, 1410 nt, Artificial Sequence; identical to SEQ ID NO: 18468
  derived and/or modified CDS sequence (AUadapt) from InfluenzaA__ABW36171__NA

SEQ ID NO: 18529 - RNA, 1413 nt, Artificial Sequence; identical to SEQ ID NO: 18484
  derived and/or modified CDS sequence (AUadapt) from InfluenzaA__ABW36193__NA

SEQ ID NO: 18530 - RNA, 1413 nt, Artificial Sequence; identical to SEQ ID NO: 18432
  derived and/or modified CDS sequence (AUadapt) from InfluenzaA__ABW36204__NA

SEQ ID NO: 18531 - RNA, 1413 nt, Artificial Sequence
  derived and/or modified CDS sequence (AUadapt) from InfluenzaA__ABW36215__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaagggcuggcucaccaucgggaucagcggccccgacaacggggcgguggccguccugaaguacaacggcaucaucacggagaccaucaaguccuggaacaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggccgcggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagccacuucuccgucaagcaggacgugguggccaucacggacuggucgggguacagcggcuccuucguccagcaccccgagcucaccggccuggacugcaucaagcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaucaucgacaaguga

SEQ ID NO: 18532 - RNA, 1413 nt, Artificial Sequence; identical to SEQ ID NO: 18432
  derived and/or modified CDS sequence (AUadapt) from InfluenzaA__ABW36226__NA

SEQ ID NO: 18533 - RNA, 1413 nt, Artificial Sequence
  derived and/or modified CDS sequence (AUadapt) from InfluenzaA__ABW36237__NA
augaaccccaaccagaagaucaucaccaucggcucgaucuccaucaccaucgggaucaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucaacaucaacaacaccaacgugguggccgggaaggacaagaccucggucacccuggcgggcaacuccagccugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcucgcccuaccgggcccugauguccugcccccugggggaggcccccagcccguacaacucgaaguucgaguccguggcguggagcgccuccgccugccacgacggcaugggcuggcucacgaucgggaucagcggccccgacaacggggccguggcgguccugaaguacaacggcaucaucaccgagaccaucaaguccuggaagaagcgcauccugcggacccaggagucggagugcgugugcgugaacggcuccugcuucacgaucaugaccgacgggcccagcaacggcgccgccuccuacaagaucuucaagaucgagaaggggaaggucaccaagucgaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugaccgucgacggcgccgacggggugaagggcuucagcuacaaguacggcaacgggguguggaucggccggaccaaguccaacaagcugcgcaagggguucgagaugaucugggaccccaacggcuggaccgacacggacagcgacuucuccgucaagcaggacgugguggcgaucaccgacuggucgggguacagcggcuccuucguccagcaccccgagcucaccggccuggacugcauccggcccugcuucuggguggagcugguccgcgggcucccgcgggagaacaccacgaucuggaccucgggcuccagcaucuccuucugcgggguggacagcgacaccgccaacugguccuggcccgacggcgccgagcugcccuucaccaucgacaaguga

SEQ ID NO: 18534 - RNA, 1413 nt, Artificial Sequence; identical to SEQ ID NO: 18432
  derived and/or modified CDS sequence (AUadapt) from InfluenzaA__ABW36248__NA

SEQ ID NO: 18535 - RNA, 1413 nt, Artificial Sequence
  derived and/or modified CDS sequence (AUadapt) from InfluenzaA__ABW36259__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggucgaaccggcccuggguguccuucaaccagaaccuggacuaccagaucggcuacaucugcagcggcguccugggggacaacccccgccccgaggacggcgagggguccugcaacccggugaccguggacggcgcggacggggucaagggcuucucguacaaguacgacaacggcguguggaucgggcggacgaaguccaaccgccuccggaagggcuucgagaugaucugggaccccaacggguggaccaacaccgacagcgacuucuccgugaagcaggacgucguggccaucaccgacuggagcggcuacucgggguccuucgugcagcaccccgagcugacgggccuggacugcauccgccccugcuucugggucgagcucgugcggggccugccgcgcgagaacaccaccaucuggaccagcggguccucgaucuccuucugcggcgucagcuccgacacggccaacuggagcuggcccgacggggccgagcugcccuucaccaucgacaaguga

SEQ ID NO: 18536 - RNA, 1413 nt, Artificial Sequence; identical to SEQ ID NO: 18432
  derived and/or modified CDS sequence (AUadapt) from InfluenzaA__ABW36281__NA

SEQ ID NO: 18537 - RNA, 1413 nt, Artificial Sequence; identical to SEQ ID NO: 18432
  derived and/or modified CDS sequence (AUadapt) from InfluenzaA__ABW36292__NA

SEQ ID NO: 18538 - RNA, 1413 nt, Artificial Sequence; identical to SEQ ID NO: 18445
  derived and/or modified CDS sequence (AUadapt) from InfluenzaA__ABW36303__NA

SEQ ID NO: 18539 - RNA, 1413 nt, Artificial Sequence
  derived and/or modified CDS sequence (AUadapt) from InfluenzaA__ABW36314__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccagcaugacccuggcgggcaacuccucgcugugcccgauccggggcugggccaucuacuccaaggacaacagcauccgcaucggguccaagggcgacguguucgugauccgggagcccuucaucagcugcucccaccucgagugccgcacguucuuccugacccagggggcccugcucaacgacaagcacucgaacggcaccgucaaggaccggucccccuaccgcgcccugaugagcugccccaucggggaggccccgucccccuacaacagccgguucgagucgguggcgugguccgccagcgccugccacgacggcaugggcuggcugaccaucgggaucuccggccccgacgacggggccguggcgguccucaaguacaacggcaucaucacggagaccaucaagagcuggcgcaagcagauccugcggacccaggaguccgagugcgugugcgugaacggcucgugcuucaccaucaugacggacgggcccuccgacggccaggccagcuaccgcaucuucaagaucgagaaggggaagaucaccaaguccaucgagcuggacgccccgaacuuccacuacgaggagugcagcugcuaccccgacaccggcaccgucaugugcgugugccgggacaacuggcacggguccaaccgccccugggugucguucaaccagaaccucgacuaccagaucggcuacaucugcuccggcgucuucggggacaacccccggccgaaggacggcaaggggagcugcgaccccgugaacguggacggcgccgacggggucaagggcuucuccuaccgcuacggcaacgggguguggaucggccggaccaagagcaacuccucgcgcaagggguucgagaugaucugggaccccaacggcuggacggacaccgacuccaacuuccuggugaagcaggacgucguggccaugaccgacuggagcggguacagcggcuccuucgugcagcaccccgagcugacgggccucgacugcaugcggccgugcuucugggucgagcugauccgcgggcggccccgcgagaagaccaccaucuggaccucgggcuccagcaucuccuucugcggggugaacagcgacacggucaacugguccuggcccgacggcgcggagcugcccuucaccaucgacaaguga

SEQ ID NO: 18540 - RNA, 1410 nt, Artificial Sequence
  derived and/or modified CDS sequence (AUadapt) from InfluenzaA__ABW38366__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgccucgugguccaaggagauccugcggacccaggagagcgagugcgucugcaucaacggcacgugcaccguggugaugaccgacggguccgccucgggcaaggcggacaccaagauccucuucaucgaggagggcaagaucguccacacgagcacccuguccgggucggcccagcacguggaggagugcuccugcuacccccgcuaccccggcgugcggugcgucugccgcgacaacuggaaggggagcaaccggccgaucguggacaucaacaucaaggacuacuccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 18541 - RNA, 1413 nt, Artificial Sequence; identical to SEQ ID NO: 18531
  derived and/or modified CDS sequence (AUadapt) from InfluenzaA__ABW39780__NA

SEQ ID NO: 18542 - RNA, 1413 nt, Artificial Sequence
  derived and/or modified CDS sequence (AUadapt) from InfluenzaA__ABW39809__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggcggggaaggacaagacccuggucacccuggccggcaacuccucgcucugcuccaucagcggcugggccaucuacaccaaggacaacuccauccggaucgggucgaagggcgacguguucgugauccgcgagccguucaucuccugcagccaccuggagugccggacguucuuccugacccagggggcccuccugaacgacaagcacuccaacggcaccgucaaggaccgcagccccuaccgggcccugauguccugcccccucggggaggcgcccucgccguacaacagcaaguucgaguccguggccuggagcgccuccgccugccacgacggcaugggcuggcugaccaucgggaucucgggccccgacaacggggcgguggccguccugaaguacaacggcaucaucacggagaccaucaaguccuggaagaagcgcauccuccggacccaggagagcgagugcgugugcgugaacggcuccugcuucaccaucaugacggacgggcccucgaacggcgccgccuccuacaagaucuucaagaucgagaaggggaaggucaccaagagcaucgagcugaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccuccggaagggguucgagaugaucugggaccccaacggcuggaccgacaccgacucggacuucuccgucaagcaggacgugguggccaucacggacuggagcggguacagcggcuccuucguccagcaccccgagcugaccggccuggacugcauccgccccugcuucuggguggagcucguccgggggcugccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18543 - RNA, 1413 nt, Artificial Sequence; identical to SEQ ID NO: 18445
  derived and/or modified CDS sequence (AUadapt) from InfluenzaA__ABW39820__NA

SEQ ID NO: 18544 - RNA, 1413 nt, Artificial Sequence
  derived and/or modified CDS sequence (AUadapt) from InfluenzaA__ABW39831__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaacggcaucaucacgggcaccaucaagagcuggaagaagcagauccugcggacccaggaguccgagugcgugugcaugaacgggagcugcuucaccaucaugacggacggccccuccaacggggccgccucguacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucucguucaaccagaaccuggacuaccagaucggcuacaucugcuccgggguguucggcgacaacccccgcccgaaggacggggagggcagcugcaaccccgugacggucgacggggccaacggcgugaagggcuucuccuacaaguacgggaacggcguguggaucgggcggaccaagagcaaccgcauccggaagggcuucgagaugaucugggaccccaacggguggaccaacaccgacuccgacuucucggucaagcaggacaucguggcgaucacggacugguccggcuacagcggcucguucgugcagcaccccgagcugaccgggcucgacugcauccgcccgugcuucugggucgagcuggugcggggccugccccgcgagaacaccaccaucuggacguccgggagcuccaucagcuucugcggcgucaacggcgacaucgccaacugguccuggcccgacggggccgagcuccccuucaccaucgacaaguga

SEQ ID NO: 18545 - RNA, 1413 nt, Artificial Sequence; identical to SEQ ID NO: 18458
  derived and/or modified CDS sequence (AUadapt) from InfluenzaA__ABW39842__NA

SEQ ID NO: 18546 - RNA, 1413 nt, Artificial Sequence; identical to SEQ ID NO: 18432
  derived and/or modified CDS sequence (AUadapt) from InfluenzaA__ABW39864__NA

SEQ ID NO: 18547 - RNA, 1410 nt, Artificial Sequence; identical to SEQ ID NO: 18468
  derived and/or modified CDS sequence (AUadapt) from InfluenzaA__ABW39875__NA

SEQ ID NO: 18548 - RNA, 1413 nt, Artificial Sequence
  derived and/or modified CDS sequence (AUadapt) from InfluenzaA__ABW39886__NA
augaaccccaaccagaagaucaucaccaucggcucgaucuccaucgccaucgggaucaucagccugauccuccagaucggcaacaucaucuccaucugggccucgcacuccauccagacccgcaaccagaaccacacggggaucugcaaccagcggaucaucaccuacgagaacagcaccugggugaaccacaccuacgucuccaucaacaacacgaacgugguggcgggcaaggacaagaccucggucacccuggccgggaacuccagccugugcuccaucagcggcugggccaucuacaccaaggacaacuccauccgcaucggcucgaagggggacguguucgugauccgggagccguucaucuccugcagccaccucgagugccgcacguucuuccugacccagggcgcccugcucaacgacaagcacuccaacgggaccgucaaggaccggucgcccuaccgcgcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgggacaacuggcacggcagcaaccgccccugggucuccuucaaccagaaccuggacuaccagaucggguacaucugcucgggcguguucggcgacaacccccggcccaaggacgggaagggcuccugcaacccggugacggucgacggggcggacggcgugaagggguucagcuacaaguacggcaacggcguguggaucgggcgcaccaaguccaaccggcugcgcaagggcuucgagaugaucugggaccccaacggguggaccgacaccgacagcgacuucuccgucaagcaggacgugguggccaucacggacuggucgggcuacagcggguccuucguccagcaccccgagcucaccggccuggacugcauccggcccugcuucuggguggagcugguccgcggccucccgcgggagaacaccaccaucuggacgucgggguccagcaucuccuucugcggcguggacagcgacaccgccaacugguccuggcccgacggggccgagcugcccuucaccaucgacaaguga

SEQ ID NO: 18549 - RNA, 1413 nt, Artificial Sequence; identical to SEQ ID NO: 18432
  derived and/or modified CDS sequence (AUadapt) from InfluenzaA__ABW39897__NA

SEQ ID NO: 18550 - RNA, 1413 nt, Artificial Sequence
  derived and/or modified CDS sequence (AUadapt) from InfluenzaA__ABW39908__NA
augaaccccaaccagaagaucaucaccaucggcucgaucuccaucgccaucgggaucaccagccugaugcuccagaucggcaacaucaucuccaucugggccucgcacuccauccagacggggagccagaaccacaccggcaucugcaaccagcgcaucaucaccuacgagaacuccaccugggugaaccacacguacgucucgaucaacaacaccaacgugguggcggggaaggacaagaccuccgucacccuggccggcaacagcucccugugcucgaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcgcccucgccguacaacuccaaguucgagagcguggccugguccgccucggccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcucgugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagucgaaccgccugcggaagggguucgagaugaucugggaccccaacggcuggaccgacacggacuccgacuucagcgucaagcaggacgugguggccaucaccgacuggucgggguacuccggcagcuucguccagcaccccgagcucaccggccuggacugcauccgccccugcuucuggguggagcugguccgggggcucccgcgcgagaacaccacgaucuggaccuccggcucguccaucagcuucugcgggguggacuccgacaccgccaacuggagcuggcccgacggcgccgagcugcccuucaccaucgacaaguga

SEQ ID NO: 18551 - RNA, 1413 nt, Artificial Sequence
  derived and/or modified CDS sequence (AUadapt) from InfluenzaA__ABW39930__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccgacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18552 - RNA, 1413 nt, Artificial Sequence
  derived and/or modified CDS sequence (AUadapt) from InfluenzaA__ABW39952__NA
augaaccccaaccagaagaucaucaccaucggcucgaucuccaucaccaucgggaucaucagccugaugcuccagaucggcaacaucaucuccaucugggccucgcacuccauccagacggggagccagaaccacaccggcaugugcaaccagcgcaucaucaccuacgagaacuccaccugggugaaccacacguacgucucgaucaacaacaccaacgugguggccgggaaggacaagaccuccgucacccuggcgggcaacagcucccugugcagcaucuccggcugggccaucuacacgaaggacaacucgauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcccccagcccguacaacuccaaguucgagucgguggcgugguccgccagcgccugccacgacggcaugggcuggcucacgaucgggaucuccggccccgacaacggggccguggcgguccugaaguacaacggcaucaucaccgagaccaucaagucguggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcucgugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggucgggguacuccggcagcuucguccagcaccccgagcucaccggccuggacugcauccgccccugcuucuggguggagcugguccgggggcucccgcgcgagaacaccacgaucuggaccuccggcucguccaucagcuucugcgggguggacuccgacaccgccaacuggagcuggcccgacggcgccgagcugcccuucaccaucgacaaguga

SEQ ID NO: 18553 - RNA, 1413 nt, Artificial Sequence; identical to SEQ ID NO: 18432
  derived and/or modified CDS sequence (AUadapt) from InfluenzaA__ABW39963__NA

SEQ ID NO: 18554 - RNA, 1413 nt, Artificial Sequence; identical to SEQ ID NO: 18432
  derived and/or modified CDS sequence (AUadapt) from InfluenzaA__ABW39985__NA

SEQ ID NO: 18555 - RNA, 1413 nt, Artificial Sequence
  derived and/or modified CDS sequence (AUadapt) from InfluenzaA__ABW39996__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcaccgccuccuacaagaucuucaagaucgagaaggggaaggucaccaagucgaucgagcucaacgcccccaacuuccacuacgaggagugcuccugcuacccggacaccggcacggugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugaccgucgacggcgccgacggggugaagggcuucagcuacaaguacggcaacgggguguggaucggccggaccaaguccaacaagcugcgcaagggguucgagaugaucugggaccccaacggcuggaccgacacggacagcgacuucuccgucaagcaggacgugguggcgaucaccgacuggucgggguacagcggcuccuucguccagcaccccgagcucaccggccuggacugcauccggcccugcuucuggguggagcugguccgcgggcucccgcgggagaacaccacgaucuggaccucgggcuccagcaucuccuucugcgggguggacagcgacaccgccaacugguccuggcccgacggcgccgagcugcccuucaccaucgacaaguga

SEQ ID NO: 18556 - RNA, 1413 nt, Artificial Sequence; identical to SEQ ID NO: 18432
  derived and/or modified CDS sequence (AUadapt) from InfluenzaA__ABW40007__NA

SEQ ID NO: 18557 - RNA, 1413 nt, Artificial Sequence
  derived and/or modified CDS sequence (AUadapt) from InfluenzaA__ABW40018__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugacggucgacggcgcggacgggaucaagggcuucucguacaaguacggcaacgggguguggaucggccggaccaaguccaaccgccugcggaagggguucgagaugaucugggaccccaacggcuggaccaacaccgacagcgacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucgacggcgacaccgccaacuggagcuggcccgacggcgccgagcugcccuucaccaucgacaaguga

SEQ ID NO: 18558 - RNA, 1410 nt, Artificial Sequence; identical to SEQ ID NO: 18286
  derived and/or modified CDS sequence (AUadapt) from InfluenzaA__ABW40029__NA

SEQ ID NO: 18559 - RNA, 1413 nt, Artificial Sequence
  derived and/or modified CDS sequence (AUadapt) from InfluenzaA__ABW40040__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggaucuggaucggccggaccaagagcaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18560 - RNA, 1413 nt, Artificial Sequence; identical to SEQ ID NO: 18432
  derived and/or modified CDS sequence (AUadapt) from InfluenzaA__ABW40051__NA

SEQ ID NO: 18561 - RNA, 1413 nt, Artificial Sequence; identical to SEQ ID NO: 18432
  derived and/or modified CDS sequence (AUadapt) from InfluenzaA__ABW40062__NA

SEQ ID NO: 18562 - RNA, 1410 nt, Artificial Sequence; identical to SEQ ID NO: 18468
  derived and/or modified CDS sequence (AUadapt) from InfluenzaA__ABW40084__NA

SEQ ID NO: 18563 - RNA, 1413 nt, Artificial Sequence
  derived and/or modified CDS sequence (AUadapt) from InfluenzaA__ABW40095__NA
augaaccccaaccagaagaucaucaccaucggcucgaucuccguggccaucgggaucaucagccugaugcuccagaucggcaacaucaucuccaucugggccucgcacuccauccagaccgggagccagaaccacacgggcaucugcaaccagcgcaucaucaccuacgagaacuccaccugggucaaccacaccuacgugucgaucaacaacacgaacguggucgcggggaaggacaagaccuccgugacccuggccggcaacagcucccugugcagcaucuccggcugggccaucuacaccaaggacaacucgauccggaucggguccaagggcgacguguucgucauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcggucgccgugcugaaguacaacggcaucaucacggagaccaucaagucguggaagaagcgcauccugcggacccaggaguccgagugcgugugcgucaacggcagcugcuucaccaucaugacggacgggcccuccaacggcgccgccagcuacaagaucuucaagaucgagaaggggaaggugaccaaguccaucgagcucaacgcccccaacuuccacuacgaggagugcucgugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggucgugcaacccgaugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18564 - RNA, 1413 nt, Artificial Sequence
  derived and/or modified CDS sequence (AUadapt) from InfluenzaA__ABW40106__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugccucaacggcagcugcuucaccaucaugacggacgggcccuccaacggcgccgccagcuacaagaucuucaagaucgagaaggggaaggugaccaaguccaucgagcugaacgcccccaacuuccacuacgaggagugcucgugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggucgugcaacccggugacgguggacggcgcggacggggucaagggcuucuccuacaaguacggcaacgggguguggaucggccggaccaagagcaaccgccuccggaagggguucgagauggugugggaccccaacggcuggaccgacaccgacuccgacuucagcgucaagcaggacgugguggccaucacggacuggucgggguacuccggcagcuucguccagcaccccgagcugaccggccuggacugcauccgccccugcuucuggguggagcucguccgggggcugccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18565 - RNA, 1413 nt, Artificial Sequence; identical to SEQ ID NO: 18432
  derived and/or modified CDS sequence (AUadapt) from InfluenzaA__ABW40117__NA

SEQ ID NO: 18566 - RNA, 1413 nt, Artificial Sequence; identical to SEQ ID NO: 18432
  derived and/or modified CDS sequence (AUadapt) from InfluenzaA__ABW40128__NA

SEQ ID NO: 18567 - RNA, 1410 nt, Artificial Sequence; identical to SEQ ID NO: 18286
  derived and/or modified CDS sequence (AUadapt) from InfluenzaA__ABW40139__NA

SEQ ID NO: 18568 - RNA, 1413 nt, Artificial Sequence; identical to SEQ ID NO: 18432
  derived and/or modified CDS sequence (AUadapt) from InfluenzaA__ABW40150__NA

SEQ ID NO: 18569 - RNA, 1413 nt, Artificial Sequence; identical to SEQ ID NO: 18432
  derived and/or modified CDS sequence (AUadapt) from InfluenzaA__ABW40161__NA

SEQ ID NO: 18570 - RNA, 1410 nt, Artificial Sequence
  derived and/or modified CDS sequence (AUadapt) from InfluenzaA__ABW40172__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucacccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 18571 - RNA, 1413 nt, Artificial Sequence; identical to SEQ ID NO: 18432
  derived and/or modified CDS sequence (AUadapt) from InfluenzaA__ABW40183__NA

SEQ ID NO: 18572 - RNA, 1410 nt, Artificial Sequence; identical to SEQ ID NO: 18286
  derived and/or modified CDS sequence (AUadapt) from InfluenzaA__ABW40194__NA

SEQ ID NO: 18573 - RNA, 1413 nt, Artificial Sequence; identical to SEQ ID NO: 18467
  derived and/or modified CDS sequence (AUadapt) from InfluenzaA__ABW40205__NA

SEQ ID NO: 18574 - RNA, 1413 nt, Artificial Sequence; identical to SEQ ID NO: 18471
  derived and/or modified CDS sequence (AUadapt) from InfluenzaA__ABW40216__NA

SEQ ID NO: 18575 - RNA, 1413 nt, Artificial Sequence; identical to SEQ ID NO: 18471
  derived and/or modified CDS sequence (AUadapt) from InfluenzaA__ABW40227__NA

SEQ ID NO: 18576 - RNA, 1413 nt, Artificial Sequence; identical to SEQ ID NO: 18432
  derived and/or modified CDS sequence (AUadapt) from InfluenzaA__ABW40238__NA

SEQ ID NO: 18577 - RNA, 1410 nt, Artificial Sequence
  derived and/or modified CDS sequence (AUadapt) from InfluenzaA__ABW40249__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccacaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgacaucaaccugaugccgaucuga

SEQ ID NO: 18578 - RNA, 1413 nt, Artificial Sequence; identical to SEQ ID NO: 18432
  derived and/or modified CDS sequence (AUadapt) from InfluenzaA__ABW40260__NA

SEQ ID NO: 18579 - RNA, 1410 nt, Artificial Sequence
  derived and/or modified CDS sequence (AUadapt) from InfluenzaA__ABW40271__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgagcaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 18580 - RNA, 1413 nt, Artificial Sequence; identical to SEQ ID NO: 18432
  derived and/or modified CDS sequence (AUadapt) from InfluenzaA__ABW40282__NA

SEQ ID NO: 18581 - RNA, 1413 nt, Artificial Sequence; identical to SEQ ID NO: 18467
  derived and/or modified CDS sequence (AUadapt) from InfluenzaA__ABW40293__NA

SEQ ID NO: 18582 - RNA, 1413 nt, Artificial Sequence; identical to SEQ ID NO: 18432
  derived and/or modified CDS sequence (AUadapt) from InfluenzaA__ABW40304__NA

SEQ ID NO: 18583 - RNA, 1413 nt, Artificial Sequence; identical to SEQ ID NO: 18432
  derived and/or modified CDS sequence (AUadapt) from InfluenzaA__ABW40315__NA

SEQ ID NO: 18584 - RNA, 1410 nt, Artificial Sequence; identical to SEQ ID NO: 18286
  derived and/or modified CDS sequence (AUadapt) from InfluenzaA__ABW40326__NA

SEQ ID NO: 18585 - RNA, 1413 nt, Artificial Sequence; identical to SEQ ID NO: 18473
  derived and/or modified CDS sequence (AUadapt) from InfluenzaA__ABW40337__NA

SEQ ID NO: 18586 - RNA, 1413 nt, Artificial Sequence; identical to SEQ ID NO: 18467
  derived and/or modified CDS sequence (AUadapt) from InfluenzaA__ABW40359__NA

SEQ ID NO: 18587 - RNA, 1413 nt, Artificial Sequence
  derived and/or modified CDS sequence (AUadapt) from InfluenzaA__ABW40370__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccucguacaagaucuucaagaucgagaaggggaaggucaccaaguccaucgagcucaacgcccccaacuuccacuacgaggagugcagcugcuacccggacuccggcaccgugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacucggacuucagcgucaagcaggacgugguggccaucaccgacugguccggguacagcggcuccuucguccagcaccccgagcucacgggccuggacugcauccgccccugcuucuggguggagcugguccgggggcucccgcgcgagaacaccaccaucuggaccucgggcuccagcaucuccuucugcgggguggacagcgacacggccaacugguccuggcccgacggcgccgagcugcccuucaccaucgacaaguga

SEQ ID NO: 18588 - RNA, 1413 nt, Artificial Sequence; identical to SEQ ID NO: 18432
  derived and/or modified CDS sequence (AUadapt) from InfluenzaA__ABW40403__NA

SEQ ID NO: 18589 - RNA, 1413 nt, Artificial Sequence
  derived and/or modified CDS sequence (AUadapt) from InfluenzaA__ABW40414__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucgaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18590 - RNA, 1413 nt, Artificial Sequence; identical to SEQ ID NO: 18432
  derived and/or modified CDS sequence (AUadapt) from InfluenzaA__ABW40425__NA

SEQ ID NO: 18591 - RNA, 1413 nt, Artificial Sequence; identical to SEQ ID NO: 18473
  derived and/or modified CDS sequence (AUadapt) from InfluenzaA__ABW40436__NA

SEQ ID NO: 18592 - RNA, 1413 nt, Artificial Sequence
  derived and/or modified CDS sequence (AUadapt) from InfluenzaA__ABW40447__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccugaacugcauccggcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 18593 - RNA, 1413 nt, Artificial Sequence; identical to SEQ ID NO: 18458
  derived and/or modified CDS sequence (AUadapt) from InfluenzaA__ABW40458__NA

SEQ ID NO: 18594 - RNA, 1413 nt, Artificial Sequence; identical to SEQ ID NO: 18432
  derived and/or modified CDS sequence (AUadapt) from InfluenzaA__ABW40469__NA

SEQ ID NO: 18595 - RNA, 1413 nt, Artificial Sequence; identical to SEQ ID NO: 18432
  derived and/or modified CDS sequence (AUadapt) from InfluenzaA__ABW40491__NA

SEQ ID NO: 18596 - RNA, 1413 nt, Artificial Sequence; identical to SEQ ID NO: 18432
  derived and/or modified CDS sequence (AUadapt) from InfluenzaA__ABW40502__NA

SEQ ID NO: 18597 - RNA, 1413 nt, Artificial Sequence; identical to SEQ ID NO: 18473
  derived and/or modified CDS sequence (AUadapt) from InfluenzaA__ABW40513__NA

SEQ ID NO: 18598 - RNA, 1413 nt, Artificial Sequence; identical to SEQ ID NO: 18432
  derived and/or modified CDS sequence (AUadapt) from InfluenzaA__ABW40524__NA

SEQ ID NO: 18599 - RNA, 1413 nt, Artificial Sequence
  derived and/or modified CDS sequence (AUadapt) from InfluenzaA__ABW40546__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgauggagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18600 - RNA, 1413 nt, Artificial Sequence; identical to SEQ ID NO: 18432
  derived and/or modified CDS sequence (AUadapt) from InfluenzaA__ABW40557__NA

SEQ ID NO: 18601 - RNA, 1413 nt, Artificial Sequence
  derived and/or modified CDS sequence (AUadapt) from InfluenzaA__ABW40568__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcagauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcaaggggucgugcaacccggugacggucgacggcgcggacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccggcccugcuucuggguggagcugguccgcgggcucccgcgggagaacaccaccaucuggacguccggcucguccaucagcuucugcgggguggacuccgacaccgccaacuggagcuggcccgacggcgccgagcugcccuucaccaucgacaaguga

SEQ ID NO: 18602 - RNA, 1413 nt, Artificial Sequence
  derived and/or modified CDS sequence (AUadapt) from InfluenzaA__ABW40579__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccucgccguacaacuccaaguucgagagcguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccaacaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18603 - RNA, 1413 nt, Artificial Sequence
  derived and/or modified CDS sequence (AUadapt) from InfluenzaA__ABW40601__NA
augaaccccaaccagaagaucaucaccaucggcucgaucuccaucgccaucggggugaucagccugaugcuccagaucggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucucgggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcggucgccgugcugaaguacaacggcaucaucacggagaccaucaaguccuggaagaagcgcauccugcggacccaggagagcgagugcgugugcgucaacggcuccugcuucaccaucaugacggacgggcccucgaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggucgaaccggcccuggguguccuucaaccagaaccuggacuaccagaucggcuacaucugcagcggcguguucggggacaacccccgccccaaggacggcaagggguccugcaacccggucacgguggacggcgcggacgggaucaagggcuucucguacaaguacggcaacgggguguggaucggccggaccaaguccaaccgccugcggaagggguucgagaugaucugggaccccaacggcuggaccaacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacggcgacaccgccaacuggagcuggcccgacggcgccgagcugcccuucaccaucgacaaguga

SEQ ID NO: 18604 - RNA, 1413 nt, Artificial Sequence; identical to SEQ ID NO: 18467
  derived and/or modified CDS sequence (AUadapt) from InfluenzaA__ABW40612__NA

SEQ ID NO: 18605 - RNA, 1413 nt, Artificial Sequence; identical to SEQ ID NO: 18432
  derived and/or modified CDS sequence (AUadapt) from InfluenzaA__ABW40623__NA

SEQ ID NO: 18606 - RNA, 1410 nt, Artificial Sequence; identical to SEQ ID NO: 18286
  derived and/or modified CDS sequence (AUadapt) from InfluenzaA__ABW40634__NA

SEQ ID NO: 18607 - RNA, 1413 nt, Artificial Sequence; identical to SEQ ID NO: 18432
  derived and/or modified CDS sequence (AUadapt) from InfluenzaA__ABW40645__NA

SEQ ID NO: 18608 - RNA, 1410 nt, Artificial Sequence
  derived and/or modified CDS sequence (AUadapt) from InfluenzaA__ABW40656__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcgggggcaucugggucacccgggagcccuacgugucgugcgaccccgacaagugcuaccaguucgcccucgggcagggcaccacgcugaacaacgugcacuccaacgacaccguccgcgaccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccaucgugucgugguccaaggagauccugcgcacccaggagagcgagugcgucugcaucaacgggacgugcaccguggugaugaccgacggcuccgccucgggcaaggccgacaccaagauccucuucaucgaggaggggaagaucguccacacgagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccagcucccacugccucgaccccaacaacgaggagggcgggcacggcgugaaggggugggccuucgacgacggcaacgacgucuggaugggccgcaccaucucggagaagucccggcugggguacgagaccuucaaggugaucgagggcuggagcaaccccaaguccaagcugcagaucaaccgccaggucaucguggaccgggggaaccgcucgggcuacuccgggaucuucagcguggagggcaagucgugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 18609 - RNA, 1413 nt, Artificial Sequence; identical to SEQ ID NO: 18473
  derived and/or modified CDS sequence (AUadapt) from InfluenzaA__ABW40667__NA

SEQ ID NO: 18610 - RNA, 1413 nt, Artificial Sequence; identical to SEQ ID NO: 18458
  derived and/or modified CDS sequence (AUadapt) from InfluenzaA__ABW40678__NA

SEQ ID NO: 18611 - RNA, 1413 nt, Artificial Sequence; identical to SEQ ID NO: 18467
  derived and/or modified CDS sequence (AUadapt) from InfluenzaA__ABW71297__NA

SEQ ID NO: 18612 - RNA, 1413 nt, Artificial Sequence; identical to SEQ ID NO: 18473
  derived and/or modified CDS sequence (AUadapt) from InfluenzaA__ABW71308__NA

SEQ ID NO: 18613 - RNA, 1413 nt, Artificial Sequence; identical to SEQ ID NO: 18432
  derived and/or modified CDS sequence (AUadapt) from InfluenzaA__ABW71319__NA

SEQ ID NO: 18614 - RNA, 1413 nt, Artificial Sequence; identical to SEQ ID NO: 18432
  derived and/or modified CDS sequence (AUadapt) from InfluenzaA__ABW71330__NA

SEQ ID NO: 18615 - RNA, 1413 nt, Artificial Sequence
  derived and/or modified CDS sequence (AUadapt) from InfluenzaA__ABW71341__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggcugggccggaccaagagcaaccgccuccggaagggguucgagaugaucugggaccccaacggcuggaccgacaccgacuccgacuucagcgucaagcaggacgugguggccaucacggacuggucgggguacuccggcagcuucguccagcaccccgagcugaccggccuggacugcauccgccccugcuucuggguggagcucguccgggggcugccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18616 - RNA, 1410 nt, Artificial Sequence; identical to SEQ ID NO: 18459
  derived and/or modified CDS sequence (AUadapt) from InfluenzaA__ABW71352__NA

SEQ ID NO: 18617 - RNA, 1413 nt, Artificial Sequence; identical to SEQ ID NO: 18473
  derived and/or modified CDS sequence (AUadapt) from InfluenzaA__ABW71363__NA

SEQ ID NO: 18618 - RNA, 1413 nt, Artificial Sequence; identical to SEQ ID NO: 18458
  derived and/or modified CDS sequence (AUadapt) from InfluenzaA__ABW71374__NA

SEQ ID NO: 18619 - RNA, 1413 nt, Artificial Sequence; identical to SEQ ID NO: 18432
  derived and/or modified CDS sequence (AUadapt) from InfluenzaA__ABW71385__NA

SEQ ID NO: 18620 - RNA, 1413 nt, Artificial Sequence
  derived and/or modified CDS sequence (AUadapt) from InfluenzaA__ABW71396__NA
augaaccccaaccagaagaucaucaccaucggcucgaucuccaucgccaucgggaucaucagccugaugcuccagaucggcaacaucaucuccaucugggccucgcacuccgugcagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccaggugggcuacaucugcucgggcgucuucggggacaacccccgccccaaggacggcaagggguccugcaacccgaugacgguggacggcgcggacggggugaagggcuucagcuacaaguacggcaacggggucuggaucggccggaccaaguccaacaagcugcgcaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccggcccugcuucugggucgagcuggugcgcgggcucccgcgggagaacgccaccaucuggaccucgggcuccagcaucuccuucugcgggguggacagcgacacggccaacugguccuggcccgacggcgccgagcugcccuucaccaucgacaaguga

SEQ ID NO: 18621 - RNA, 1413 nt, Artificial Sequence
  derived and/or modified CDS sequence (AUadapt) from InfluenzaA__ABW71407__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacaagauccgcaagggguucgagaugaucugggaccccaacggcuggaccgacaccgacagcgacuucuccgucaagcaggacgugguggccaucacggacuggucgggguacagcggcuccuucguccagcaccccgagcugaccggccucgacugcauccggcccugcuucuggguggagcugguccgcgggcugccgcgggagaacaccaccaucuggacgucgggcuccagcaucuccuucugcgggguggacagcgacaccgccaacugguccuggcccgacggcgccgagcuccccuucaccaucgacaaguga

SEQ ID NO: 18622 - RNA, 1413 nt, Artificial Sequence; identical to SEQ ID NO: 18458
  derived and/or modified CDS sequence (AUadapt) from InfluenzaA__ABW71418__NA

SEQ ID NO: 18623 - RNA, 1413 nt, Artificial Sequence; identical to SEQ ID NO: 18432
  derived and/or modified CDS sequence (AUadapt) from InfluenzaA__ABW71440__NA

SEQ ID NO: 18624 - RNA, 1413 nt, Artificial Sequence; identical to SEQ ID NO: 18432
  derived and/or modified CDS sequence (AUadapt) from InfluenzaA__ABW71451__NA

SEQ ID NO: 18625 - RNA, 1413 nt, Artificial Sequence; identical to SEQ ID NO: 18467
  derived and/or modified CDS sequence (AUadapt) from InfluenzaA__ABW71462__NA

SEQ ID NO: 18626 - RNA, 1410 nt, Artificial Sequence; identical to SEQ ID NO: 16729
  derived and/or modified CDS sequence (AUadapt) from InfluenzaA__ABW80980__NA

SEQ ID NO: 18627 - RNA, 1410 nt, Artificial Sequence; identical to SEQ ID NO: 16573
  derived and/or modified CDS sequence (AUadapt) from InfluenzaA__ABW80981__NA

SEQ ID NO: 18628 - RNA, 1413 nt, Artificial Sequence
  derived and/or modified CDS sequence (AUadapt) from InfluenzaA__ABW81474__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagaagaucaucaccuacgagaaccgcaccugggucaaccagaccuacgugaacuucaacaacacgaacguggucgcggggaaggacaagccguccaugacccuggccggcaacucgucccugugccccauccggggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccaucaaggaccggucccccuuccgcgcccugaugagcugcccgcugggggaggcgcccucccccuacaacucgcgguucgaguccgucgccuggagcgccucggccugccacgacggccucggcuggcugaccaucgggaucuccggccccgacaacggggcgguggccgugcugaaguacaacggcaucaucaccgagacgaucaagagcuggaagaagcagauccuccgcacccaggaguccgagugcgucugcgugaacggcucgugcuucaccaucaugaccgacgggccguccaaccgggccgccagcuaccgcaucuucaagaucgagaagggccgggugacgaaguccaucgagcuggacgcccccaacuaccacuacgaggagugcucgugcuaccccgacaccgggaccgucaugugcgugugccgcgacaacuggcacggcuccaaccggcccugggugagcuucaaccagaaccuggacuaccagaucggguacaucugcuccggcgucuucggcgacaacccgcgccccaaggacggggagggcagcugcaaccccgugaccguggacggggcggacggcgucaagggguucuccuaccgguacggcaacggcguguggaucgggcgcaccaagucgaaccggcuccgcaagggcuucgagaugaucugggaccccaacggguggacggacaccgacuccgacuucagcaugaagcaggacguggucgccaugaccgacugguccggcuacucgggguccuucgugcagcacccggagcugacgggccuggacugcaugcggcccugcuucuggguggagcucguccgcggccugccccgggagaacaccaccaucuggaccagcgggucguccaucagcuucugcggcgugaacuccgagacggccaacuggagcuggcccgacggggccgagcugccguucaccaucgacaaguga

SEQ ID NO: 18629 - RNA, 1413 nt, Artificial Sequence
  derived and/or modified CDS sequence (AUadapt) from InfluenzaA__ABW81475__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagucguccgucacccuggccggcaacagcucccugugcagcaucuccggcugggccaucuacaccaaggacaacucgauccggaucggguccaagggcgacguguucgugauccgcgagccguucaucagcugcucccaccucgagugccggaccuucuuccugacgcagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucaccgagacgaucaagucguggaagaagcgcauccugcggacccaggaguccgagugcgugugcgugaacggcagcugcuucaccaucaugaccgacgggcccuccaacggcgccgccagcuacaagaucuucaagaucgagaaggggaaggucacgaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcgaggggucgugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucagccucaagcaggacgucguggccaucaccgacuggucgggguacuccggcagcuucgugcagcaccccgagcugacgggccuggacugcauccgccccugcuucugggucgagcucgugcgggggcugccgcgcgagaacaccaccaucuggaccuccggcucguccaucagcuucugcggggucaacuccgacacggccaacuggagcuggcccgacggcgccgagcugcccuucaccaucgacaaguga

SEQ ID NO: 18630 - RNA, 1413 nt, Artificial Sequence
  derived and/or modified CDS sequence (AUadapt) from InfluenzaA__ABW81477__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagagcaucgagcucuccgcccccaacuuccacuacgaggagugcucgugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcgaggggucgugcaacccggugacggucgacggcgcgaacggggugaagggcuucuccuacaaguacggcaacgggguguggaucggccgcaccaagagcaaccggcugcgcaagggguucgagaugaucugggaccccaacggcuggcccgacaccgacuccgacuucagcgucaagcaggacgugguggccaucaccgacuggucgggguacuccggcagcuucguccagcaccccgagcucacgggccuggacugcauccggccgugcuucuggguggagcugguccgcgggcuccccaaggagaacaccaccaucuggaccuccggcucguccaucagcuucugcggggugaacuccgacacggccaacuggagcuggcccgacggcgccgagcugcccuucaccaucgacaaguga

SEQ ID NO: 18631 - RNA, 1413 nt, Artificial Sequence
  derived and/or modified CDS sequence (AUadapt) from InfluenzaA__ABW81478__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggucgaaccggcccugggucuccuucaaccagaaccuggacuaccagaucggcuacaucugcagcggcguguucggggacaacccccgccccaaggacggcgagggguccugcaacccggugacggucgacggcgcggacggggugaagggcuucucguacaaguacggcaacgggguguggaucggccggaccaagaacaaccgccugcggaagggguucgagaugaucugggaccccaacggcuggaccgacaccgacuccgacuucagcgucaagcaggacgugguggccaucacggacugguccggguacucgggcagcuucguccagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 18632 - RNA, 1413 nt, Artificial Sequence
  derived and/or modified CDS sequence (AUadapt) from InfluenzaA__ABW81479__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagaagaucaucaccuacgagaaccgcaccugggucaaccagaccuacgugaacaucaacaacacgaacguggucgcggggaaggacaagccguccaugacccuggccggcaacucgucccugugccccauccggggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccaucaaggaccggucccccuuccgcgcccugaugucgugcccgcugggggaggcgcccucccccuacaacagccgguucgaguccgucgccuggucggccagcgccugccacgacggccucggcuggcugaccaucgggaucuccggccccgacaacggggcgguggccgugcugaaguacaacggcaucaucaccgagacgaucaagucguggaagaagcagauccuccgcacccaggaguccgagugcgucugcgugaacggcagcugcuucaccaucaugaccgacgggccguccaaccgggccgccucguaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugucguucaaccagaaccuggacuaccagaucggguacaucugcuccggcgucuucggcgacaacccgcgccccaaggacggggagggcagcugcaaccccgugaccguggacggggcggacggcaucaagggguucuccuaccgguacggcaacggcgucuggaucgggcgcaccaagucgaaccggcuccgcaagggcuucgagaugaucugggaccccaacggguggacggacaccgacuccgacuucagcaugaagcaggacgugguggccaugaccgacugguccggcuacucgggguccuucguccagcacccggagcugacgggccuggacugcaugcggcccugcuucuggguggagcucgugcgcggccugccccgggagaacaccaccaucuggaccagcgggucguccaucagcuucugcggcgucaacuccgagacggccaacuggagcuggcccgacggggccgagcugccguucaccaucgacaaguga

SEQ ID NO: 18633 - RNA, 1413 nt, Artificial Sequence; identical to SEQ ID NO: 16798
  derived and/or modified CDS sequence (AUadapt) from InfluenzaA__ABW81480__NA

SEQ ID NO: 18634 - RNA, 1413 nt, Artificial Sequence
  derived and/or modified CDS sequence (AUadapt) from InfluenzaA__ABW81481__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagaagaucaucaccuacgagaaccgcaccugggucaaccagaccuacgugaacaucaacaacacgaacguggucgcggggaaggacaagccguccaugacccuggccggcaacucgucccugugccccauccggggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccaucaaggaccggucccccuuccgcgcccugaugucgugcccgcugggggaggcgcccucccccuacaacagccgguucgaguccgucgccuggucggccagcgccugccacgacggccucggcuggcugaccaucgggaucuccggccccgacaacggggcgguggccgugcugaaguacaacggcaucaucaccgagacgaucaagucguggaagaagcagauccuccgcacccaggaguccgagugcgucugcgugaacggcagcugcuucaccaucaugaccgacgggccguccaaccgggccgccucguaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugucguucaaccagaaccuggacuaccagaucggguacaucugcuccggcgucuucggcgacaacccgcgccccaaggacggggagggcagcugcaaccccgugaccguggacggggcggacggcgucaagggguucuccuaccgguacggcaacggcguguggaucgggcgcaccaagucgaaccggcuccgcaagggcuucgagaugaucugggaccccaacggguggacggacaccgacuccgacuucagcaugaagcaggacguggucgccaugaccgacugguccggcuacucgggguccuucgugcagcacccggagcugacgggccuggacugcaugcggcccugcuucuggguggagcucguccgcggccugccccgggagaacaccaccaucuggaccagcgggucguccaucagcuucugcggcgugaacuccgagacggccaacuggagcuggcccgacggggccgagcugccguucaccaucgacaaguga

SEQ ID NO: 18635 - RNA, 1413 nt, Artificial Sequence
  derived and/or modified CDS sequence (AUadapt) from InfluenzaA__ABW81482__NA
augaaccccaaccagaagaucaucaccaucggcucgaucuccguggccaucgggaucaucagccugauccuccagaucggcaacaucaucuccaucugggccucgcacuccauccagaccgggagccagaacuacacgggcaucugcaaccagaagaucaucaccuacgagaaccgcaccugggucaaccagaccuacgugaacaucaacaacacgaacguggucgcggggaaggacaagccguccaugacccuggccggcaacucgucccugugccccauccggggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccaucaaggaccggucccccuuccgcgcccugaugucgugcccgcugggggaggcgcccucccccuacaacagccgguucgaguccgucgccuggucggccagcgccugccacgacggccucggcuggcugaccaucgggaucuccggccccgacaacggggcgguggccgugcugaaguacaacggcaucaucaccgagacgaucaagucguggaagaagcagauccuccgcacccaggaguccgagugcgucugcgugaacggcagcugcuucaccaucaugaccgacgggccguccaaccgggccgccucguaccgcaucuucaagaucgagaagggccgggugacgaaguccaucgagcuggacgcccccaacuaccacuacgaggagugcagcugcuaccccgacaccgggaccgucaugugcgugugccgcgacaacuggcacggcuccaaccggcccugggugucguucaaccagaaccuggacuaccagaucggguacaucugcuccggcgucuucggcgacaacccgcgccccaaggacggggagggcagcugcaaccccgugaccguggacggggcggacggcgucaagggguucuccuaccgguacggcaacggcguguggaucgggcgcaccaagucgaaccggcuccgcaagggcuucgagaugaucugggaccccaacggguggacggacaccgacuccgacuucagcaugaagcaggacguggucgccaugaccgacugguccggcuacucgggguccuucgugcagcacccggagcugacgggccuggccugcaugcggcccugcuucuggguggagcucguccgcggccugccccgggagaacaccaccaucuggaccagcgggucguccaucagcuucugcggcgugaacuccgagacggccaacuggagcuggcccgacggggccgagcugccguucaccaucgacaaguga

SEQ ID NO: 18636 - RNA, 1413 nt, Artificial Sequence; identical to SEQ ID NO: 16788
  derived and/or modified CDS sequence (AUadapt) from InfluenzaA__ABW81483__NA

SEQ ID NO: 18637 - RNA, 1413 nt, Artificial Sequence
  derived and/or modified CDS sequence (AUadapt) from InfluenzaA__ABW81484__NA
augaaccccaaccagaagaucaucaccaucggcucgaucuccaucgccaucgggaucaucagccugaugcuccagaucggcaacaucaucuccaucugggccucgcacuccauccagaccgggaaccagaaccacacgggcaucugcaaccagcgcaucaucaccuacgagaacagcaccugggugaaccacaccuacgucaacaucaacaacacgaacgugguggcggggaagggcaagaccuccgucacccuggccggcaacucgucccugugcagcaucuccgggugggccaucuacaccaaggacaacucgauccggaucggcuccaagggggacguguucgugauccgcgagccguucaucagcugcucccaccucgagugccggacguucuuccugacccagggcgcccugcucaacgacaagcacucgaacgggaccgucaaggaccgcucccccuaccgggcccugaugagcugcccccugggcgaggcgcccuccccguacaacucgaaguucgagagcguggccugguccgccagcgccugccacgacggcaugggguggcucaccaucggcaucuccgggcccgacaacggcgcgguggccguccugaaguacaacggcaucaucacggagaccaucaagucguggaagaagcgcauccugcggacccaggaguccgagugcgugugcgugaacgggagcugcuucaccaucaugacggacggccccuccaacggggccgccucguacaagaucuucaagaucgagaagggcaaggucaccaaguccaucgagcucaacgcccccaacuuccacuacgaggagugcagcugcuacccggacaccgggaccgugaugugcgugugccgcgacaacuggcacggcuccaaccggcccugggucucguucaaccagaaccuggacuaccagaucggcuacaucugcuccgggguguucggcgacaacccccgccccaaggacgggaagggcagcugcaacccggugacggucgacggggcggacggcgugaagggcuucuccuacaaguacgggaacggcguguggaucgggcggaccaagucgaaccgccugcggaagggcuucgagaugaucugggaccccaacggguggaccgacaccgacuccgacuucagcgucaagcaggacgugguggccaucacggacugguccggcuacucgggcagcuucguccagcaccccgagcucaccgggcuggacugcauccgccccugcuucuggguggagcugguccggggccucccgcgcgagaacaccaccaucuggacguccgggucguccaucagcuucugcggcguggacuccgacaccgccaacuggagcuggcccgacggcgccgagcugcccuucaccaucgacaaguga

SEQ ID NO: 18638 - RNA, 1413 nt, Artificial Sequence
  derived and/or modified CDS sequence (AUadapt) from InfluenzaA__ABW81487__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucauccagcaccccgagcucaccggccuggacugcauccgccccugcuucugggucgagcuggugcgggggcucccgcgcgagaacaccaccaucuggacgucgggcuccagcaucuccuucugcggggucgacagcgacaccgccaacugguccuggcccgacggcgccgagcugcccuucaccaucgacaaguga

SEQ ID NO: 18639 - RNA, 1413 nt, Artificial Sequence; identical to SEQ ID NO: 16788
  derived and/or modified CDS sequence (AUadapt) from InfluenzaA__ABW81488__NA

SEQ ID NO: 18640 - RNA, 1413 nt, Artificial Sequence; identical to SEQ ID NO: 16788
  derived and/or modified CDS sequence (AUadapt) from InfluenzaA__ABW81489__NA

SEQ ID NO: 18641 - RNA, 1413 nt, Artificial Sequence
  derived and/or modified CDS sequence (AUadapt) from InfluenzaA__ABW81490__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugcaagacguucuuccugacccagggggcccugcucaacgacaagcacuccaacggcaccgucaaggaccggucgcccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcaagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 18642 - RNA, 1413 nt, Artificial Sequence
  derived and/or modified CDS sequence (AUadapt) from InfluenzaA__ABW81491__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18643 - RNA, 1413 nt, Artificial Sequence
  derived and/or modified CDS sequence (AUadapt) from InfluenzaA__ABW81492__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucugggccucgggcuccagcaucuccuucugcgggguggacagcgacacggccaacugguccuggcccgacggcgccgagcugcccuucaccaucgacaaguga

SEQ ID NO: 18644 - RNA, 1413 nt, Artificial Sequence; identical to SEQ ID NO: 16788
  derived and/or modified CDS sequence (AUadapt) from InfluenzaA__ABW81493__NA

SEQ ID NO: 18645 - RNA, 1413 nt, Artificial Sequence; identical to SEQ ID NO: 16788
  derived and/or modified CDS sequence (AUadapt) from InfluenzaA__ABW81494__NA

SEQ ID NO: 18646 - RNA, 1413 nt, Artificial Sequence; identical to SEQ ID NO: 16788
  derived and/or modified CDS sequence (AUadapt) from InfluenzaA__ABW81495__NA

SEQ ID NO: 18647 - RNA, 1413 nt, Artificial Sequence; identical to SEQ ID NO: 18642
  derived and/or modified CDS sequence (AUadapt) from InfluenzaA__ABW81497__NA

SEQ ID NO: 18648 - RNA, 1413 nt, Artificial Sequence
  derived and/or modified CDS sequence (AUadapt) from InfluenzaA__ABW81498__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccugggagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18649 - RNA, 1413 nt, Artificial Sequence
  derived and/or modified CDS sequence (AUadapt) from InfluenzaA__ABW81499__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggcgggacaagaccucggucacccuggccggcaacuccagccugugcuccaucagcggcugggccaucuacaccaaggacaacuccauccgcaucgggucgaagggcgacguguucgugauccgggagccguucaucuccugcagccaccucgagugccgcacguucuuccugacccagggggcccugcucaacgacaagcacuccaacggcaccgucaaggaccggucgcccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcggauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccugggucuccuucaaccagaaccuggacuaccagaucggcuacaucugcucgggcguguucggggacaacccccggcccaaggacggcaagggguccugcaacccggugacggucgacggcgcggacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 18650 - RNA, 1413 nt, Artificial Sequence
  derived and/or modified CDS sequence (AUadapt) from InfluenzaA__ABW81500__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuuccacuacgaggagugcuccugcuacccggacaccggcaccgugaugugcgugugccgcgacaacuggcacgggucgaaccggcccugggucuccuucaaccagaaccuggacuaccagaucggcuacaucugcagcggcguguucggggacaacccccgccccaaggacggcaagggguccugcaacccggugacggcggacggcgccgacggggucaagggcuucucguacaaguacggcaacgggguguggaucggccggaccaaguccaaccgccugcggaagggguucgagaugaucugggaccccaacggcuggaccgacaccgacagcgacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucgacagcgacaccgccaacugguccuggcccgacggcgccgagcugcccuucaccaucgacaaguga

SEQ ID NO: 18651 - RNA, 1413 nt, Artificial Sequence
  derived and/or modified CDS sequence (AUadapt) from InfluenzaA__ABW81501__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagaagaucaucaccuacgagaacuccaccugggugaaccacaccuacgucaacaucaacaacacgaacgugguggcggggaaggacaagaccucggucacccuggccggcaacuccagccugugcuccgugagcggcugggccaucuacaccaaggacaacuccauccgcaucgggucgaagggcgacguguucgucauccgggagccguucaucuccugcagccaccucgagugccgcacguucuuccugacccagggggcccugcucaacgacaagcacuccaacggcaccgugaaggaccggucgcccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcggauccugcgcacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgggacaacuggcacgggagcaaccgccccuggguguccuucaaccagaaccuggacuaccagaucggcuacaucugcucgggcguguucggggacaacccccggcccaaggacggcaagggguccugcaacccggucacgguggacggcgcggacggggugaagggcuucagcuacaaguacggcaacggggucuggaucggccgcaccaaguccaaccggcugcgcaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 18652 - RNA, 1413 nt, Artificial Sequence; identical to SEQ ID NO: 18473
  derived and/or modified CDS sequence (AUadapt) from InfluenzaA__ABW86324__NA

SEQ ID NO: 18653 - RNA, 1413 nt, Artificial Sequence; identical to SEQ ID NO: 18445
  derived and/or modified CDS sequence (AUadapt) from InfluenzaA__ABW86335__NA

SEQ ID NO: 18654 - RNA, 1413 nt, Artificial Sequence; identical to SEQ ID NO: 18432
  derived and/or modified CDS sequence (AUadapt) from InfluenzaA__ABW86346__NA

SEQ ID NO: 18655 - RNA, 1413 nt, Artificial Sequence; identical to SEQ ID NO: 18432
  derived and/or modified CDS sequence (AUadapt) from InfluenzaA__ABW86357__NA

SEQ ID NO: 18656 - RNA, 1413 nt, Artificial Sequence; identical to SEQ ID NO: 18432
  derived and/or modified CDS sequence (AUadapt) from InfluenzaA__ABW86368__NA

SEQ ID NO: 18657 - RNA, 1413 nt, Artificial Sequence; identical to SEQ ID NO: 18458
  derived and/or modified CDS sequence (AUadapt) from InfluenzaA__ABW86379__NA

SEQ ID NO: 18658 - RNA, 1413 nt, Artificial Sequence; identical to SEQ ID NO: 18432
  derived and/or modified CDS sequence (AUadapt) from InfluenzaA__ABW86390__NA

SEQ ID NO: 18659 - RNA, 1413 nt, Artificial Sequence; identical to SEQ ID NO: 18473
  derived and/or modified CDS sequence (AUadapt) from InfluenzaA__ABW86401__NA

SEQ ID NO: 18660 - RNA, 1413 nt, Artificial Sequence; identical to SEQ ID NO: 18432
  derived and/or modified CDS sequence (AUadapt) from InfluenzaA__ABW86412__NA

SEQ ID NO: 18661 - RNA, 1413 nt, Artificial Sequence
  derived and/or modified CDS sequence (AUadapt) from InfluenzaA__ABW86423__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucgccaucaugaccgacgggcccagcaacggcgccgccuccuacaagaucuucaagaucgagaaggggaaggucaccaagucgaucgagcucaacgcgcccaacuuccacuacgaggagugcuccugcuacccggacacgggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugaccgucgacggcgccgacggggugaagggcuucagcuacaaguacggcaacgggguguggaucggccggacgaaguccaacaagcugcgcaagggguucgagaugaucugggaccccaacggcuggaccgacaccgacagcgacuucuccgucaagcaggacgugguggccaucaccgacuggucgggguacagcggcuccuucguccagcaccccgagcucacgggccuggacugcauccggcccugcuucuggguggagcugguccgcgggcucccgcgggagaacaccaccaucuggaccucgggcuccagcaucuccuucugcgggguggacagcgacacggccaacugguccuggcccgacggcgccgagcugcccuucaccaucgacaaguga

SEQ ID NO: 18662 - RNA, 1413 nt, Artificial Sequence; identical to SEQ ID NO: 18432
  derived and/or modified CDS sequence (AUadapt) from InfluenzaA__ABW86434__NA

SEQ ID NO: 18663 - RNA, 1413 nt, Artificial Sequence; identical to SEQ ID NO: 18432
  derived and/or modified CDS sequence (AUadapt) from InfluenzaA__ABW86445__NA

SEQ ID NO: 18664 - RNA, 1413 nt, Artificial Sequence; identical to SEQ ID NO: 18467
  derived and/or modified CDS sequence (AUadapt) from InfluenzaA__ABW86456__NA

SEQ ID NO: 18665 - RNA, 1413 nt, Artificial Sequence
  derived and/or modified CDS sequence (AUadapt) from InfluenzaA__ABW86467__NA
augaacaccaaccagaagaucaucaccaucggcucgaucuccaucgccaucgggaucaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucucgaucaacaacaccaacgugguggcggggaaggacaagaccuccgucacccuggccggcaacagcucccugugcagcaucuccggcugggccaucuacacgaaggacaacucgauccggaucggguccaagggcgacguguucgugauccgcgagcccuucaucagcugcucccaccucgagugccggaccuucuuccugacccagggggcccugcucaacgacaagcacucgaacggcaccgucaaggaccgcuccccguaccgggcccugaugagcugcccccugggggaggcgcccagccccuacaacuccaaguucgagucgguggccugguccgccagcgccugccacgacggcaugggcuggcucacgaucgggaucuccggcccggacaacggggcgguggccguccugaaguacaacggcaucaucaccgagaccaucaagucguggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcucgugcuaccccgacaccggcacggugaugugcgugugccgcgacaacuggcacggguccaaccggccgugggucagcuucaaccagaaccuggacuaccagaucggcuacaucugcuccggcguguucggggacaacccccgccccaaggacggcaaggggucgugcaaccccgugaccgucgacggcgcggacggggugaagggcuucuccuacaaguacggcaacgggguguggaucggccggaccaagagcaaccgccugcggaagggguucgagaugaucugggacccgaacggcuggaccgacacggacuccgacuucagcaucaagcaggacgucguggccaucaccgacuggucgggguacuccggcagcuucgugcagcaccccgagcucaccggccuggacugcauccgccccugcuucugggucgagcuggugcgggggcucccccgcgagaacaccacgaucuggaccuccggcucguccaucagcuucugcggggucgacuccgacaccgccaacuggagcuggccggacggcgccgagcugcccuucaccaucgacaaguga

SEQ ID NO: 18666 - RNA, 1413 nt, Artificial Sequence; identical to SEQ ID NO: 18467
  derived and/or modified CDS sequence (AUadapt) from InfluenzaA__ABW86478__NA

SEQ ID NO: 18667 - RNA, 1413 nt, Artificial Sequence
  derived and/or modified CDS sequence (AUadapt) from InfluenzaA__ABW86489__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggggaucacggacuggucgggcuacuccggcagcuucguccagcaccccgagcucaccgggcuggacugcauccgccccugcuucuggguggagcugguccggggccucccgcgcgagaacaccaccaucuggacguccgggucguccaucagcuucugcggcguggacuccgacaccgccaacuggagcuggcccgacggcgccgagcugcccuucaccaucgacaaguga

SEQ ID NO: 18668 - RNA, 1413 nt, Artificial Sequence
  derived and/or modified CDS sequence (AUadapt) from InfluenzaA__ABW86500__NA
augaaccccaaccagaagaucaugaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacagcgacuucuccaugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucgacagcgacaccgccaacugguccuggcccgacggcgccgagcugcccuucaccaucgacaaguga

SEQ ID NO: 18669 - RNA, 1413 nt, Artificial Sequence; identical to SEQ ID NO: 18432
  derived and/or modified CDS sequence (AUadapt) from InfluenzaA__ABW86511__NA

SEQ ID NO: 18670 - RNA, 1413 nt, Artificial Sequence
  derived and/or modified CDS sequence (AUadapt) from InfluenzaA__ABW86522__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccgucacggacuggucgggguacagcggcuccuucgugcagcaccccgagcucaccggccuggacugcauccggcccugcuucugggucgagcuggugcgcgggcucccgcgggagaacgccaccaucuggaccucgggcuccagcaucuccuucugcgggguggacagcgacacggccaacugguccuggcccgacggcgccgagcugcccuucaccaucgacaaguga

SEQ ID NO: 18671 - RNA, 1413 nt, Artificial Sequence; identical to SEQ ID NO: 18432
  derived and/or modified CDS sequence (AUadapt) from InfluenzaA__ABW86533__NA

SEQ ID NO: 18672 - RNA, 1413 nt, Artificial Sequence; identical to SEQ ID NO: 18467
  derived and/or modified CDS sequence (AUadapt) from InfluenzaA__ABW86544__NA

SEQ ID NO: 18673 - RNA, 1413 nt, Artificial Sequence; identical to SEQ ID NO: 18432
  derived and/or modified CDS sequence (AUadapt) from InfluenzaA__ABW86555__NA

SEQ ID NO: 18674 - RNA, 1410 nt, Artificial Sequence
  derived and/or modified CDS sequence (AUadapt) from InfluenzaA__ABW86566__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccgugaucgagcgcaacaucaccgagaucgucuaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggugacccgggagcccuacgugagcugcgaccccgacaagugcuaccaguucgcccucggccaggggacgacccugaacaacguccacuccaacgacaccgugcgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccaucuga

SEQ ID NO: 18675 - RNA, 1413 nt, Artificial Sequence; identical to SEQ ID NO: 18458
  derived and/or modified CDS sequence (AUadapt) from InfluenzaA__ABW86609__NA

SEQ ID NO: 18676 - RNA, 1413 nt, Artificial Sequence; identical to SEQ ID NO: 17461
  derived and/or modified CDS sequence (AUadapt) from InfluenzaA__ABW91188__NA

SEQ ID NO: 18677 - RNA, 1410 nt, Artificial Sequence
  derived and/or modified CDS sequence (AUadapt) from InfluenzaA__ABW91210__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18678 - RNA, 1413 nt, Artificial Sequence; identical to SEQ ID NO: 18432
  derived and/or modified CDS sequence (AUadapt) from InfluenzaA__ABW91221__NA

SEQ ID NO: 18679 - RNA, 1410 nt, Artificial Sequence
  derived and/or modified CDS sequence (AUadapt) from InfluenzaA__ABW91232__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagucgacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacucgaucguguccuggagcaaggagauccugcgcacccaggaguccgagugcgucugcaucaacggcacgugcaccguggugaugaccgacgggucggccagcggcaaggccgacaccaagauccucuucaucgaggagggcaagaucguccacacguccacccugucgggguccgcgcagcacguggaggagugcagcugcuacccccgguaccccggcgugcgcugcgucugccgggacaacuggaagggguccaaccgccccaucguggacaucaacaucaaggaccacucgaucguguccagcuacgucugcuccggccuggugggcgacaccccgcggaagaacgacucguccagcuccgggcacugccucgaccccaacaacgaggagggcgggcacggcgugaaggggugggccuucgacgacggcaacgacgucuggaugggccgcaccaucucggagaagucccggcugggguacgagacguucaaggugaucgagggcuggagcaaccccaaguccaagcugcagaucaaccgccaggucaucguggaccgggggaaccgcucgggcuacuccgggaucuucagcguggagggcaagucgugcaucaaccggugcuucuacgucgagcucauccgcggccggaaggaggagaccgaggugcuguggaccuccaacagcaucguggucuucugcgggaccuccggcacguacgggaccggcagcuggcccgacggggccgacaucaaccugaugccgaucuga

SEQ ID NO: 18680 - RNA, 1410 nt, Artificial Sequence; identical to SEQ ID NO: 18468
  derived and/or modified CDS sequence (AUadapt) from InfluenzaA__ABW91243__NA

SEQ ID NO: 18681 - RNA, 1410 nt, Artificial Sequence; identical to SEQ ID NO: 18286
  derived and/or modified CDS sequence (AUadapt) from InfluenzaA__ABW91254__NA

SEQ ID NO: 18682 - RNA, 1410 nt, Artificial Sequence; identical to SEQ ID NO: 18286
  derived and/or modified CDS sequence (AUadapt) from InfluenzaA__ABW91265__NA

SEQ ID NO: 18683 - RNA, 1413 nt, Artificial Sequence; identical to SEQ ID NO: 18432
  derived and/or modified CDS sequence (AUadapt) from InfluenzaA__ABW91276__NA

SEQ ID NO: 18684 - RNA, 1413 nt, Artificial Sequence
  derived and/or modified CDS sequence (AUadapt) from InfluenzaA__ABW91287__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacaucuucgugauccgcgagccguucaucuccugcucgcaccucgagugccggacguucuuccugacccagggcgcccugcucaacgacaagcacuccaacgggaccgugaaggaccgcagccccuaccgggcccugauguccugcccccugggcgaggcgcccucgccguacaacagccgcuucgaguccgucgccuggagcgccuccgccugccacgacgggaugggcuggcucaccaucggcaucucggggcccgacaacggcgcgguggccgugcugaaguacaacgggaucaucacggagaccaucaaguccuggaagaagcggauccugcgcacccaggagagcgagugcgucugcaugaacggcuccugcuucaccaucaugacggacggccccucgaacggggccgccuccuacaagaucuucaagaucgagaagggcaaggugaccaagaccaucgagcucaacgcccccaacuuccacuacgaggagugcagcugcuacccggacaccgggacggugaugugcgucugccgggacaacuggcacggcuccaaccgccccugggugucguucaaccagaaccuggacuaccagaucggguacaucugcuccggcguguucggcgacaacccccggcccaaggacggggagggcagcugcaacccggucaccguggacggggcggacggcgugaagggguucuccuacaaguacggcaacggcgucuggaucgggcgcaccaagucgaaccggcugcgcaagggcuucgagaugaucugggaccccaacggguggaccaacacggacuccgacuucagcgugaagcaggacaucguggccaucaccgacugguccggcuacucggggagcuucguccagcaccccgagcucaccggccuggacugcauccggcccugcuucuggguggagcuggugcgcggccucccgcgggagaacaccacgaucuggaccuccgggucguccaucagcuucugcggcgucaacuccgggaccgccaacuggagcuggcccgacggcgccgagcugcccuucaccaucgacaaguga

SEQ ID NO: 18685 - RNA, 1413 nt, Artificial Sequence; identical to SEQ ID NO: 18432
  derived and/or modified CDS sequence (AUadapt) from InfluenzaA__ABW91298__NA

SEQ ID NO: 18686 - RNA, 1413 nt, Artificial Sequence
  derived and/or modified CDS sequence (AUadapt) from InfluenzaA__ABW91309__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccucgccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcucgugcuucaccaucaugacggacgggcccuccgacggcgccgccagcuacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugacggcggacggcgccgacggggucaagggcuucuccuacaaguacggcaacgggguguggaucggccggaccaagucgaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18687 - RNA, 1413 nt, Artificial Sequence; identical to SEQ ID NO: 18432
  derived and/or modified CDS sequence (AUadapt) from InfluenzaA__ABW91320__NA

SEQ ID NO: 18688 - RNA, 1413 nt, Artificial Sequence; identical to SEQ ID NO: 18432
  derived and/or modified CDS sequence (AUadapt) from InfluenzaA__ABW91331__NA

SEQ ID NO: 18689 - RNA, 1413 nt, Artificial Sequence; identical to SEQ ID NO: 18432
  derived and/or modified CDS sequence (AUadapt) from InfluenzaA__ABW91342__NA

SEQ ID NO: 18690 - RNA, 1413 nt, Artificial Sequence; identical to SEQ ID NO: 18432
  derived and/or modified CDS sequence (AUadapt) from InfluenzaA__ABW91353__NA

SEQ ID NO: 18691 - RNA, 1413 nt, Artificial Sequence
  derived and/or modified CDS sequence (AUadapt) from InfluenzaA__ABW91364__NA
augaacaccaaccagaagaucaucaccaucggcucgaucuccaucgccaucgggaucaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucaacaucaacaacaccaacguggugaccgggaaggacaagaccucggucacgcuggcgggcaacuccagccugugcuccaucucgggcugggccaucuacaccaaggacaacuccauccggaucgggagcaagggcgacguguucgugauccgcgagcccuucaucuccugcucgcaccucgagugccggaccuucuuccugacccagggggcccugcucaacgacaagcacuccaacggcacggucaaggaccgcagcccguaccgggcccugauguccugcccccugggggaggcccccucgcccuacaacagcaaguucgaguccguggcguggagcgccuccgccugccacgacggcaugggcuggcucaccaucgggaucucgggcccggacaacggggccguggcgguccugaaguacaacggcaucaucaccgagaccaucaaguccuggaagaagcgcauccugcggacgcaggagagcgagugcgugugcgugaacggcuccugcuucaccaucaugaccgacgggcccucggacggcgccgccuccuacaagaucuucaagaucgagaaggggaaggucaccaagagcaucgagcucaacgcccccaacuuccacuacgaggagugcuccugcuaccccgacacgggcaccgugaugugcgugugccgcgacaacuggcacgggucgaaccggccgugggucuccuucaaccagaaccuggacuaccagaucggcuacaucugcagcggcguguucggggacaacccccgccccaaggacggcaagggguccugcaaccccgugaccgucgacggcgccgacggggugaagggcuucucguacaaguacggcaacgggguguggaucggccggaccaaguccaacaagcugcgcaagggguucgagaugaucugggacccgaacggcuggacggacaccgacaacgacuucagcgucaagcaggacgugguggcgaucaccgacugguccggguacucgggcagcuucguccagcaccccgagcucaccggccuggacugcauccggcccugcuucuggguggagcugguccgcgggcucccccgggagaacacgaccaucuggaccuccggcucguccaucagcuucugcgggguggacuccgacaccgccaacuggagcuggccggacggcgccgagcugcccuucacgaucgacaaguga

SEQ ID NO: 18692 - RNA, 1413 nt, Artificial Sequence; identical to SEQ ID NO: 18432
  derived and/or modified CDS sequence (AUadapt) from InfluenzaA__ABW91375__NA

SEQ ID NO: 18693 - RNA, 1413 nt, Artificial Sequence; identical to SEQ ID NO: 18458
  derived and/or modified CDS sequence (AUadapt) from InfluenzaA__ABW91386__NA

SEQ ID NO: 18694 - RNA, 1410 nt, Artificial Sequence
  derived and/or modified CDS sequence (AUadapt) from InfluenzaA__ABW91397__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcaucugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 18695 - RNA, 1413 nt, Artificial Sequence; identical to SEQ ID NO: 18603
  derived and/or modified CDS sequence (AUadapt) from InfluenzaA__ABW91408__NA

SEQ ID NO: 18696 - RNA, 1413 nt, Artificial Sequence
  derived and/or modified CDS sequence (AUadapt) from InfluenzaA__ABW91419__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggagaaggacaagaccucggucacccuggccgggaacuccagccugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcgcauccugcggacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccaggugggguacaucugcucgggcguguucggcgacaacccccgccccaaggacgggaagggcuccugcaacccgaugacggucgacggggcggacggcgugaagggguucagcuacaaguacggcaacggcguguggaucgggcggaccaaguccaacaagcugcgcaagggcuucgagaugaucugggaccccaacggguggaccgacaccgacagcgacuucuccgucaagcaggacgugguggccaucacggacuggucgggcuacagcggguccuucguccagcaccccgagcucaccggccuggacugcauccggcccugcuucuggguggagcugguccgcggccucccgcgggagaacaccaccaucuggacgucgggguccagcaucuccuucugcggcguggacagcgacaccgccaacugguccuggcccgacggggccgagcugcccuucaccaucgacaaguga

SEQ ID NO: 18697 - RNA, 1413 nt, Artificial Sequence
  derived and/or modified CDS sequence (AUadapt) from InfluenzaA__ABW91430__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggguccguggcgguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccaggugggcuacaucugcuccggcguguucggggacaacccccgccccaaggacggcaaggggucgugcaacccgaugacggucgacggcgccgacggggugaagggcuucuccuacaaguacggcaacgggguguggaucggccggaccaagagcaacaagcugcgcaagggguucgagaugaucugggaccccaacggcuggaccgacaccgacuccgacuucagcgucaagcaggacgugguggcgaucacggacuggucgggguacuccggcagcuucguccagcaccccgagcucaccggccuggacugcauccggcccugcuucuggguggagcugguccgcgggcucccgcgggagaacaccaccaucuggacguccggcucguccaucagcuucugcgggguggacuccgacaccgccaacuggagcuggcccgacggcgccgagcugcccuucaccaucgacaaguga

SEQ ID NO: 18698 - RNA, 1410 nt, Artificial Sequence; identical to SEQ ID NO: 18286
  derived and/or modified CDS sequence (AUadapt) from InfluenzaA__ABW91441__NA

SEQ ID NO: 18699 - RNA, 1413 nt, Artificial Sequence; identical to SEQ ID NO: 18473
  derived and/or modified CDS sequence (AUadapt) from InfluenzaA__ABW91452__NA

SEQ ID NO: 18700 - RNA, 1413 nt, Artificial Sequence; identical to SEQ ID NO: 18473
  derived and/or modified CDS sequence (AUadapt) from InfluenzaA__ABW91463__NA

SEQ ID NO: 18701 - RNA, 1413 nt, Artificial Sequence; identical to SEQ ID NO: 18432
  derived and/or modified CDS sequence (AUadapt) from InfluenzaA__ABW91474__NA

SEQ ID NO: 18702 - RNA, 1413 nt, Artificial Sequence; identical to SEQ ID NO: 18473
  derived and/or modified CDS sequence (AUadapt) from InfluenzaA__ABW91485__NA

SEQ ID NO: 18703 - RNA, 1413 nt, Artificial Sequence; identical to SEQ ID NO: 18432
  derived and/or modified CDS sequence (AUadapt) from InfluenzaA__ABW91496__NA

SEQ ID NO: 18704 - RNA, 1413 nt, Artificial Sequence; identical to SEQ ID NO: 18458
  derived and/or modified CDS sequence (AUadapt) from InfluenzaA__ABW91507__NA

SEQ ID NO: 18705 - RNA, 1413 nt, Artificial Sequence; identical to SEQ ID NO: 18473
  derived and/or modified CDS sequence (AUadapt) from InfluenzaA__ABW91518__NA

SEQ ID NO: 18706 - RNA, 1413 nt, Artificial Sequence
  derived and/or modified CDS sequence (AUadapt) from InfluenzaA__ABW91529__NA
augaaccccaaccagaagaucaucaccaucggcucgaucuccaucgccaucgggaccaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucucgaucaacaacaccaacgugguggcggggaaggacaagaccuccgucacccuggccggcaacagcucccugugcucgaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacucgaacggcaccaucaaggaccgcucccccuaccgggcccugaugagcugcccccugggggaggcgcccucgccguacaacuccaaguucgagagcgucgccugguccgccucggccugccacgacggcaugggcuggcucacgaucgggaucuccggccccgacaacggggcgguggccgugcugaaguacaacggcaucaucaccgagaccaucaagagcuggaagaagcgcauccugcggacccaggaguccgagugcgucugcgugaacggcucgugcuucacgaucaugaccgacgggcccuccaacggcgccgccagcuacaagaucuucaagaucgagaaggggaaggugaccaaguccaucgagcucaacgcccccaacuuccacuacgaggagugcagcugcuacccggacaccggcacggucaugugcgugugccgcgacaacuggcacggguccaaccggcccugggugucguucaaccagaaccuggacuaccagaucggcuacaucugcuccggcgucuucggggacaacccccgccccaaggacggcaaggggagcugcaacccggugaccguggacggcgcggacggggucaagggcuucuccuacaaguacggcaacgggguguggaucggccggaccaagucgaaccgccugcggaagggguucgagaugaucugggaccccaacggcuggaccgacacggacuccgacuucagcgugaagcaggacgucguggccaucaccgacuggucgggguacuccggcagcuucgugcagcaccccgagcucaccggccuggacugcauccgccccugcuucugggucgagcuggugcgggggcucccgcgcgagaacaccacgaucuggaccuccggcucguccaucagcuucugcggggucgacuccgacaccgccaacuggagcuggcccgacggcgccgagcugcccuucaccaucgacaaguga

SEQ ID NO: 18707 - RNA, 1413 nt, Artificial Sequence
  derived and/or modified CDS sequence (AUadapt) from InfluenzaA__ABW91540__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccuggaugaaccacaccuacgugucgaucaacaacacgaacgucguggcggggaaggacaagaccuccgugacccuggccggcaacagcucccugugcagcaucuccggcugggccaucuacaccaaggacaacucgauccggaucggguccaagggcgacgucuucgugauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucggucgccugguccgccagcgccugccacgacggcaugggcuggcucaccaucgggaucuccggccccgacaacggggcgguggccgugcugaaguacaacggcaucaucacggagaccaucaagucguggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccgucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18708 - RNA, 1410 nt, Artificial Sequence
  derived and/or modified CDS sequence (AUadapt) from InfluenzaA__ABW91551__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacucgaucguguccuggagcaaggagauccugcgcacccaggaguccgagugcgucugcaucaacggcacgugcaccguggugaugaccgacgggucggccuccggcaaggccgacaccaagauccucuucaucgaggagggcaagaucguccacacgagcacccugagcggguccgcgcagcacguggaggagugcucgugcuacccccgguaccccggcgugcgcugcgucugccgggacaacuggaagggguccaaccgcccgaucguggacaucaacaucaaggaccacagcaucguguccucguacgucugcuccggccuggugggcgacacgccccggaagaacgacagcuccucguccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccccaagucgaagcugcagaucaaccgccaggucaucguggaccggggcaaccgcuccggguacagcggcaucuucuccguggagggcaagucgugcaucaaccggugcuucuacgucgagcucauccgcgggcggaaggaggagaccgaggugcuguggaccagcaacuccaucguggucuucugcggcaccagcgggacguacggcaccggguccuggccggacggcgccgacaucaaccugaugcccaucuga

SEQ ID NO: 18709 - RNA, 1413 nt, Artificial Sequence; identical to SEQ ID NO: 18432
  derived and/or modified CDS sequence (AUadapt) from InfluenzaA__ABW91562__NA

SEQ ID NO: 18710 - RNA, 1413 nt, Artificial Sequence; identical to SEQ ID NO: 18467
  derived and/or modified CDS sequence (AUadapt) from InfluenzaA__ABW91584__NA

SEQ ID NO: 18711 - RNA, 1413 nt, Artificial Sequence; identical to SEQ ID NO: 18432
  derived and/or modified CDS sequence (AUadapt) from InfluenzaA__ABW91595__NA

SEQ ID NO: 18712 - RNA, 1413 nt, Artificial Sequence; identical to SEQ ID NO: 18473
  derived and/or modified CDS sequence (AUadapt) from InfluenzaA__ABW91606__NA

SEQ ID NO: 18713 - RNA, 1413 nt, Artificial Sequence; identical to SEQ ID NO: 18467
  derived and/or modified CDS sequence (AUadapt) from InfluenzaA__ABW91617__NA

SEQ ID NO: 18714 - RNA, 1413 nt, Artificial Sequence; identical to SEQ ID NO: 18432
  derived and/or modified CDS sequence (AUadapt) from InfluenzaA__ABW91628__NA

SEQ ID NO: 18715 - RNA, 1413 nt, Artificial Sequence; identical to SEQ ID NO: 18432
  derived and/or modified CDS sequence (AUadapt) from InfluenzaA__ABW91639__NA

SEQ ID NO: 18716 - RNA, 1410 nt, Artificial Sequence; identical to SEQ ID NO: 18286
  derived and/or modified CDS sequence (AUadapt) from InfluenzaA__ABW91650__NA

SEQ ID NO: 18717 - RNA, 1350 nt, Artificial Sequence
  derived and/or modified CDS sequence (AUadapt) from InfluenzaA__ABX10517__NA
augaaucccaacaagaagaucaucaccaucggcucgaucugcauggugaccgggauggucucccugaugcuccagaucggcaaccugaucagcaucugggugucccacaguauccacacggggaaccagcacaaggccgagccgaucuccaacaccaacuuccugaccgagaaggccguggcgagcgucaagcucgccggcaauuccagccugugccccaucaacgggugggccgugcacuccaaggacaacaguauccgcaucggcuccaagggcgacguguucgucauccgggagcccuucaucagcugcucccaccuggagugccgcaccuuuuuccucacgcagggggcccugcugaacgacaagcacagcaacggcaccgugaaggaccggaguccccaccgcacccucauguccugcccggugggggaggcccccucccccuacaacagccgguucgaguccgucgcguggagugccagcgccugccacgacggcaccuccuggcugacgaucgggaucagcggccccgacaacggcgccguggcggugcugaaguauaacgggaucaucaccgacaccaucaaguccuggcgcaacaacauccuccggacccaggagagcgagugcgccugugucaacggcuccugcuucacggugaugaccgacgggccgucgaacggccaggccucccacaagaucuuuaagauggagaagggcaagguggucaagagcguggagcuggacgcccccaacuaccacuacgaggagugcuccuguuaccccgacgccggggagaucacgugcgugugccgcgacaacuggcauggcagcaaccggcccugggucuccuucaaccagaaccuggaguaccagaucggguacaucuguagcggcguguucggggacaacccgcgccccaacgacggcaccggcuccugugggcccgugagcuccaacggcgcguacggggucaagggcuucagcuucaaguacgggaauggcguguggaucggccggaccaaguccaccaacagccgcuccggguucgagaugaucugggaccccaacggcuggaccgagaccgacagcaguuucuccgugaagcaggacaucgucgccaucacggacuggagcggguacuccggcagcuuugugcagcacccggagcucaccgggcuggacugcauccggcccugcuucugggucgagcugauccgcggccggcccaaggaguccaccaucugggccagcggcuccagcaucuccuuuugcggggugaacagcgacaccgugggcugguccuggcccgacggggccgagcucccguucacgaucgacaaguga

SEQ ID NO: 18718 - RNA, 1410 nt, Artificial Sequence; identical to SEQ ID NO: 18331
  derived and/or modified CDS sequence (AUadapt) from InfluenzaA__ABX10527__NA

SEQ ID NO: 18719 - RNA, 1413 nt, Artificial Sequence
  derived and/or modified CDS sequence (AUadapt) from InfluenzaA__ABX58242__NA
augaaccccaaccagaagaucaucaccaucggcucgaucuccaucgccaucgggaucaucagccugaugcuccagaucggcaacaucaucuccaucuggaccucgcacuccauccagacggggagccagaaccacaccggcaucugcaaccagcgcaucaucaccuacgagaacuccaccugggugaaccacacguacgucucgaucaacaacaccaacgugguggccgggaaggacaagaccuccgucacccuggcgggcaacagcucccugugcagcaucuccggcugggccaucuacacgaaggacaacucgauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcccccagcccguacaacuccaaguucgagucgguggcgugguccgccagcgccugccacgacggcaugggcuggcucacgaucgggaucuccggccccgacaacggggccguggcgguccugaaguacaacggcaucaucaccgagaccaucaagucguggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcucgugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggucgggguacuccggcagcuucguccagcaccccgagcucaccggccuggacugcauccgccccugcuucuggguggagcugguccgggggcucccgcgcgagaacaccacgaucuggaccuccggcucguccaucagcuucugcgggguggacuccgacaccgccaacuggagcuggcccgacggcgccgagcugcccuucaccaucgacaaguga

SEQ ID NO: 18720 - RNA, 1413 nt, Artificial Sequence; identical to SEQ ID NO: 18531
  derived and/or modified CDS sequence (AUadapt) from InfluenzaA__ABX58253__NA

SEQ ID NO: 18721 - RNA, 1413 nt, Artificial Sequence; identical to SEQ ID NO: 18432
  derived and/or modified CDS sequence (AUadapt) from InfluenzaA__ABX58264__NA

SEQ ID NO: 18722 - RNA, 1413 nt, Artificial Sequence; identical to SEQ ID NO: 18432
  derived and/or modified CDS sequence (AUadapt) from InfluenzaA__ABX58275__NA

SEQ ID NO: 18723 - RNA, 1413 nt, Artificial Sequence; identical to SEQ ID NO: 18432
  derived and/or modified CDS sequence (AUadapt) from InfluenzaA__ABX58286__NA

SEQ ID NO: 18724 - RNA, 1413 nt, Artificial Sequence
  derived and/or modified CDS sequence (AUadapt) from InfluenzaA__ABX58297__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagaagaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccgcaucggguccaagggcgacguguucgugauccgggagccguucaucagcugcucccaccucgagugccgcacguucuuccugacccagggggcccugcucaacgacaagcacucgaacggcaccgucaaggaccggucccccuaccgcgcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcggauccugcgcacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgggacaacuggcacggguccaaccgccccugggucagcuucaaccagaaccuggacuaccagaucggcuacaucugcuccggcguguucggggacaacccccggcccaaggacggcaaggggucgugcaacccggugacggucgacggcgcggacggggugaagggcuucuccuacaaguacggcaacgggguguggaucggccgcaccaagagcaaccggcugcgcaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccggcccugcuucuggguggagcugguccgcgggcucccgcgggagaacaccaccaucuggacguccggcucguccaucagcuucugcgggguggacuccgacaccgccaacuggagcuggcccgacggcgccgagcugcccuucaccaucgacaaguga

SEQ ID NO: 18725 - RNA, 1413 nt, Artificial Sequence; identical to SEQ ID NO: 18603
  derived and/or modified CDS sequence (AUadapt) from InfluenzaA__ABX58308__NA

SEQ ID NO: 18726 - RNA, 1413 nt, Artificial Sequence
  derived and/or modified CDS sequence (AUadapt) from InfluenzaA__ABX58319__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccaucaaggaccgcucccccuaccgggcccugaugagcugcccccugggggaggcgcccagcccguacaacuccaaguucgagucggucgccugguccgccagcgccugccacgacggcaugggcuggcucaccaucgggaucuccggccccgacaacggggcgguggccgugcugaaguacaacggcaucaucacggagaccaucaagucguggaagaagcgcauccugcggacccaggaguccgagugcgucugcgugaacggcagcugcuucaccaucaugacggacgggcccuccaacggcgccgccagcuacaagaucuucaagaucgagaaggggaaggugaccaaguccaucgagcucaacgcccccaacuuccacuacgaggagugcucgugcuacccggacaccggcaccgucaugugcgugugccgcgacaacuggcacggguccaaccggcccugggugagcuucaaccagaaccuggacuaccagaucggcuacaucugcuccggcgucuucggggacaacccccgccccaaggacggcaaggggucgugcaacccggugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18727 - RNA, 1413 nt, Artificial Sequence; identical to SEQ ID NO: 18603
  derived and/or modified CDS sequence (AUadapt) from InfluenzaA__ABX58352__NA

SEQ ID NO: 18728 - RNA, 1413 nt, Artificial Sequence; identical to SEQ ID NO: 18432
  derived and/or modified CDS sequence (AUadapt) from InfluenzaA__ABX58363__NA

SEQ ID NO: 18729 - RNA, 1413 nt, Artificial Sequence; identical to SEQ ID NO: 18432
  derived and/or modified CDS sequence (AUadapt) from InfluenzaA__ABX58385__NA

SEQ ID NO: 18730 - RNA, 1413 nt, Artificial Sequence; identical to SEQ ID NO: 18432
  derived and/or modified CDS sequence (AUadapt) from InfluenzaA__ABX58396__NA

SEQ ID NO: 18731 - RNA, 1413 nt, Artificial Sequence
  derived and/or modified CDS sequence (AUadapt) from InfluenzaA__ABX58407__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcccgaucagcggcugggccaucuacaccaaggacaacuccauccggaucgggucgaagggcgacguguucgugauccgcgagcccuucaucuccugcagccaccucgagugccggacguucuuccugacccagggggcccugcucaacgacaagcacuccaacggcaccgucaaggaccgcucgcccuaccgggcccugauguccugcccccugggggaggcgccgagccccuacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgccccgaacuuccacuacgaggagugcuccugcuaccccgacaccggcaccgugaugugcgugugccgcgacaacuggcacgggagcaaccggcccugggucuccuucaaccagaaccuggacuaccagaucggcuacaucugcucgggcguguucggggacaacccccgcccgaaggacggcaagggguccugcaaccccgugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgcccgugcuucuggguggagcugguccgggggcucccccgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18732 - RNA, 1413 nt, Artificial Sequence; identical to SEQ ID NO: 18473
  derived and/or modified CDS sequence (AUadapt) from InfluenzaA__ABX58418__NA

SEQ ID NO: 18733 - RNA, 1413 nt, Artificial Sequence; identical to SEQ ID NO: 18432
  derived and/or modified CDS sequence (AUadapt) from InfluenzaA__ABX58429__NA

SEQ ID NO: 18734 - RNA, 1413 nt, Artificial Sequence; identical to SEQ ID NO: 18432
  derived and/or modified CDS sequence (AUadapt) from InfluenzaA__ABX58440__NA

SEQ ID NO: 18735 - RNA, 1413 nt, Artificial Sequence
  derived and/or modified CDS sequence (AUadapt) from InfluenzaA__ABX58451__NA
augaaccccaaccagaagaucaucaccaucggcucgaucuccaucgccaucgggaccaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucucgaucaacaacaccaacgugguggcggggaaggacaagaccuccgucacccuggccggcaacagcucccugugcucgaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcgcccucgccguacaacuccaaguucgagagcguggccugguccgccucggccugccacgacggcaugggcuggcucacgaucgggaucuccggccccgacaacggggcgguggccguccugaaguacaacggcaucaucaccgagaccaucaagagcuggaagaagcgcauccugcggacccaggaguccgagugcgugugcgugaacggcucgugcuucacgaucaugaccgacgggcccuccaacggcgccgccagcuacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagucgaaccgccugcggaagggguucgagaugaucugggaccccaacggcuggaccgacacggacuccgacuucagcgucaagcaggacgugguggccaucaccgacuggucgggguacuccggcagcuucguccagcaccccgagcucaccggccuggacugcauccgccccugcuucuggguggagcugguccgggggcucccgcgcgagaacaccacgaucuggaccuccggcucguccaucagcuucugcgggguggacuccgacaccgccaacuggagcuggcccgacggcgccgagcugcccuucaccaucgacaaguga

SEQ ID NO: 18736 - RNA, 1413 nt, Artificial Sequence; identical to SEQ ID NO: 18473
  derived and/or modified CDS sequence (AUadapt) from InfluenzaA__ABX58462__NA

SEQ ID NO: 18737 - RNA, 1413 nt, Artificial Sequence; identical to SEQ ID NO: 18432
  derived and/or modified CDS sequence (AUadapt) from InfluenzaA__ABX58473__NA

SEQ ID NO: 18738 - RNA, 1413 nt, Artificial Sequence; identical to SEQ ID NO: 18473
  derived and/or modified CDS sequence (AUadapt) from InfluenzaA__ABX58484__NA

SEQ ID NO: 18739 - RNA, 1413 nt, Artificial Sequence
  derived and/or modified CDS sequence (AUadapt) from InfluenzaA__ABX58495__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaaccgcaccgucaaggaccggucccccuaccgcgcccugaugagcugcccccugggcgaggcgcccagcccguacaacuccaaguucgagucgguggccugguccgccagcgccugccacgacgggaugggcuggcucaccaucggcaucuccgggcccgacaacggcgcgguggccguccugaaguacaacgggaucaucacggagaccaucaagucguggaagaagcggauccugcgcacccaggaguccgagugcgugugcgugaacggcagcugcuucaccaucaugacggacggccccuccaacggggccgccagcuacaagaucuucaagaucgagaagggcaaggucaccaaguccaucgagcucaacgcccccaacuuccacuacgaggagugcucgugcuacccggacaccgggaccgugaugugcgugugccgggacaacuggcacggcuccaaccgccccugggucagcuucaaccagaaccuggacuaccagaucggguacaucugcuccggcguguucggcgacaacccccggcccaaggacgggaagggcucgugcaacccggugacggucgacggggcggacggcgugaagggguucuccuacaaguacggcaacggcguguggaucgggcgcaccaagagcaaccggcugcgcaagggcuucgagaugaucugggaccccaacggguggaccgacaccgacuccgacuucagcgucaagcaggacgugguggccaucacggacuggucgggcuacuccgggagcuucguccagcaccccgagcucaccggccuggacugcauccggcccugcuucuggguggagcugguccgcggccucccgcgggagaacaccaccaucuggacguccgggucguccaucagcuucugcggcguggacuccgacaccgccaacuggagcuggcccgacggggccgagcugcccuucaccaucgacaaguga

SEQ ID NO: 18740 - RNA, 1413 nt, Artificial Sequence; identical to SEQ ID NO: 18467
  derived and/or modified CDS sequence (AUadapt) from InfluenzaA__ABX58506__NA

SEQ ID NO: 18741 - RNA, 1413 nt, Artificial Sequence; identical to SEQ ID NO: 18473
  derived and/or modified CDS sequence (AUadapt) from InfluenzaA__ABX58528__NA

SEQ ID NO: 18742 - RNA, 1413 nt, Artificial Sequence; identical to SEQ ID NO: 18473
  derived and/or modified CDS sequence (AUadapt) from InfluenzaA__ABX58539__NA

SEQ ID NO: 18743 - RNA, 1413 nt, Artificial Sequence
  derived and/or modified CDS sequence (AUadapt) from InfluenzaA__ABX58550__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccguggacaaguga

SEQ ID NO: 18744 - RNA, 1413 nt, Artificial Sequence; identical to SEQ ID NO: 18432
  derived and/or modified CDS sequence (AUadapt) from InfluenzaA__ABX58561__NA

SEQ ID NO: 18745 - RNA, 1413 nt, Artificial Sequence
  derived and/or modified CDS sequence (AUadapt) from InfluenzaA__ABX58572__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccgaugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18746 - RNA, 1413 nt, Artificial Sequence; identical to SEQ ID NO: 18432
  derived and/or modified CDS sequence (AUadapt) from InfluenzaA__ABX58583__NA

SEQ ID NO: 18747 - RNA, 1413 nt, Artificial Sequence; identical to SEQ ID NO: 18432
  derived and/or modified CDS sequence (AUadapt) from InfluenzaA__ABX58594__NA

SEQ ID NO: 18748 - RNA, 1413 nt, Artificial Sequence; identical to SEQ ID NO: 18458
  derived and/or modified CDS sequence (AUadapt) from InfluenzaA__ABX58605__NA

SEQ ID NO: 18749 - RNA, 1413 nt, Artificial Sequence; identical to SEQ ID NO: 18458
  derived and/or modified CDS sequence (AUadapt) from InfluenzaA__ABX58616__NA

SEQ ID NO: 18750 - RNA, 1413 nt, Artificial Sequence; identical to SEQ ID NO: 18432
  derived and/or modified CDS sequence (AUadapt) from InfluenzaA__ABX58627__NA

SEQ ID NO: 18751 - RNA, 1413 nt, Artificial Sequence; identical to SEQ ID NO: 18432
  derived and/or modified CDS sequence (AUadapt) from InfluenzaA__ABX58638__NA

SEQ ID NO: 18752 - RNA, 1413 nt, Artificial Sequence
  derived and/or modified CDS sequence (AUadapt) from InfluenzaA__ABX58682__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccaugaugugcgugugccgcgacaacuggcacggguccaaccggcccugggugagcuucaaccagaaccuggacuaccagaucggcuacaucugcuccggcgucuucggggacaacccccgccccaaggacggcaaggggucgugcaacccggugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucagcgugaagcaggacgucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18753 - RNA, 1413 nt, Artificial Sequence
  derived and/or modified CDS sequence (AUadapt) from InfluenzaA__ABX58693__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaaccgggccgccuccuacaagaucuucaagaucgagaaggggaaggugaccaagucgaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcucgggcguccugggggacaacccccgccccgaggacggcgagggguccugcaacccggugaccguggacggcgcggacggggucaagggcuucagcuacaaguacgacaacggcguguggaucgggcggacgaaguccaaccgccuccggaagggcuucgagaugaucugggaccccaacggguggaccaacaccgacagcgacuucuccgugaagcaggacgucguggccaucaccgacuggucgggcuacagcggguccuucgugcagcaccccgagcugacgggccuggacugcauccgccccugcuucugggucgagcucgugcggggccugccgcgcgagaacaccaccaucuggaccucgggguccagcaucuccuucugcggcgucaacagcgacacggccaacugguccuggcccgacggggccgagcugcccuucaccaucgacaaguga

SEQ ID NO: 18754 - RNA, 1413 nt, Artificial Sequence; identical to SEQ ID NO: 18603
  derived and/or modified CDS sequence (AUadapt) from InfluenzaA__ABX58704__NA

SEQ ID NO: 18755 - RNA, 1413 nt, Artificial Sequence; identical to SEQ ID NO: 18531
  derived and/or modified CDS sequence (AUadapt) from InfluenzaA__ABX58715__NA

SEQ ID NO: 18756 - RNA, 1350 nt, Artificial Sequence
  derived and/or modified CDS sequence (AUadapt) from InfluenzaA__ABY19420__NA
augaaucccaaccagaaggugaucaccaucggcagcaucugcauggucaucgggaucgugucccugaugcuccagaucggcaacaugaucagcaucugggugucccacagcauccagaccgggaaucagaaccaggucgagccgaucaucaacacgaacuuccugaccggcaaggccguggccuccaucacccuggcggggaacagcucccucugccccauccgcggcugggccauccacaguaaggacaacuccauccggaucggcagcaagggggacguguucgucauccgcgagcccuucaucuccugcagucaccuggagugccggaccuucuuccugacgcagggcgcccuccugaacgacaagcacuccaacgggaccgugaaggaucgcagcccccaccggacccugauguccugcccggugggcgaggcccccagccccuacaacucccgcuucgagagugucgccugguccgcgagcgccugccacgacgggaccagcuggcucacgaucggcaucuccggccccgacaacggggccguggccgugcugaaguacaauggcaucaucaccgacaccaucaagagcuggcggaacaacauccugcgcacccaggaguccgagugcgcgugcgucaacgggaguugcuucacggugaugaccgacggcccguccaacggccaggccagcuacaagaucuucaagauggagaaggggaaggugaucaaguccgucgagcucgacgcccccaauuaccacuacgaggagugcagcugcuaccccgacgccggcgagaucacgugugugugccgggacaacuggcacggguccaaccgccccugggugagcuucaaucagaaccuggaguaccagaucggcuacaucugcuccggggucuucggcgacaacccgcggcccaacgauggcaccgggagcugcggccccgugucccacaacggggccuacggcgugaagggguucagcuuuaaguacggcaacggcgucuggaucgggcgcaccaagucccccaacagccgguccggcuucgagaugaucugggacccgaacggguggagcgagaccgauuccagcuucagcgugaagcaggacaucguggcgaucaccgacugguccggcuacagcggguccuuuguccagcaccccgagcugaccggccucgacugcauccgccccugcuucuggguggagcugauccggggccgccccaaggagagcacggucuggaccuccgggagcuccaucagcuuuugcggcgugaacuccgacaccgugagcugguccuggccggacggggccgagcugcccuucagcaucgacaaguga

SEQ ID NO: 18757 - RNA, 1350 nt, Artificial Sequence
  derived and/or modified CDS sequence (AUadapt) from InfluenzaA__ABY19421__NA
augaaucccaaccagaagaucaucaccaucggcucgaucugcauggugaucgggaucgucucccugaugcuccagaucggcaacaugaucagcaucugggugucccacagcauccagaccgggaaccagaaucagguggagccgaucaucaacacgaacuuccugaccggcaaggccgucgccuccaucacccuggcggggaacagcucccucugccccauccgcggcugggccauccacagcaaggauaacuccauccggaucggcagcaagggggacguguucgugauccgcgagcccuucaucuccugcagccaccuggagugucggaccuucuuccugacgcagggcgcccuccugaacgacaagcacuccaacgggaccgucaaggaccgcagcccccaucggacccugauguccugcccggugggcgaggcccccagccccuacaacucccgcuucgagagcguggccugguccgcgagcgccugccaugacgggaccagcuggcucacgaucggcaucuccggccccgacaacggggccgucgccgugcugaaguacaacggcaucaucaccgacaccaucaagagcuggcggaauaacauccugcgcacccaggaguccgagugcgcgugcgugaacgggagcugcuucacggucaugaccgacggcccguccaauggccaggccagcuacaagaucuucaagauggagaaggggaaggugaucaaguccguggagcucgacgcccccaacuaccacuacgaggagugcaguugcuaccccgacgccggcgagaucacgugcgucugccgggacaacuggcacggguccaaucgccccugggugagcuucaaccagaaccuggaguaccagaucggcuacaucugcuccgggguguucggcgauaacccgcggcccaacgacggcaccgggagcugcggccccgucucccacaacggggccuacggcgugaagggguuuagcuucaaguacggcaacggcguguggaucgggcgcaccaagucccccaacagccgguccggcuucgagaugaucugggacccgaauggguggagcgagaccgacuccagcuucagcgucaagcaggacaucguggcgaucaccgacugguccggcuacaguggguccuucgugcagcaccccgagcugaccggccucgacugcauccgccccugcuucugggucgagcugauccggggccgccccaaggagagcacgguguggaccuccgggagcuccaucaguuucugcggcgucaacuccgacaccgugagcugguccuggccggacggggccgagcugcccuucagcaucgacaaguga

SEQ ID NO: 18758 - RNA, 1413 nt, Artificial Sequence
  derived and/or modified CDS sequence (AUadapt) from InfluenzaA__ABY51020__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccgcugacgguggacggcgcggacggggucaagggcuucuccuacaaguacggcaacgggguguggaucggccggaccaagagcaaccgccuccggaagggguucgagaugaucugggaccccaacggcuggaccgacaccgacuccgacuucagcgugaagcaggacgucguggccaucacggacuggucgggguacuccggcagcuucgugcagcaccccgagcugaccggccuggacugcauccgccccugcuucugggucgagcucgugcgggggcugccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18759 - RNA, 1410 nt, Artificial Sequence; identical to SEQ ID NO: 18468
  derived and/or modified CDS sequence (AUadapt) from InfluenzaA__ABY51031__NA

SEQ ID NO: 18760 - RNA, 1413 nt, Artificial Sequence
  derived and/or modified CDS sequence (AUadapt) from InfluenzaA__ABY51042__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugaccguggacggcgcggacggggucaagggcuucagcuacaaguacgacaacggcguguggaucgggcggacgaaguccaaccgccugcggaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccgccccugcuucugggucgagcuggugcggggccucccgcgcgagaacaccaccaucuggaccucgggguccagcaucuccuucugcggcgucaacagcgacacggccaacugguccuggcccgacggggccgagcugcccuucaccaucgacaaguga

SEQ ID NO: 18761 - RNA, 1413 nt, Artificial Sequence
  derived and/or modified CDS sequence (AUadapt) from InfluenzaA__ABY51053__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaaccgggccgccuccuacaagaucuucaagaucgagaaggggaaggugaccaagagcaucgagcucaacgcccccaacuuccacuacgaggagugcuccugcuacccggacaccggcaucgucaugugcgugugccgcgacaacuggcacgggagcaaccggcccuggguguccuucaaccagaaccuggacuaccagaucggcuacaucugcucgggcgucuucggggacaacccccgccccgaggacggcgagggguccugcaacccggugaccguggacggcacggacggggucaagggcuucagcuacaaguacgacaacggcguguggaucgggcggaccaaguccaaccgccugcggaagggcuucgagaugaucugggaccccaacggguggaccaacaccgacucggacuucuccgugaagcaggacgucguggcgaucacggacuggagcggcuacagcggguccuucgugcagcaccccgagcucaccggccuggacugcauccgccccugcuucugggucgagcuggugcggggccucccgcgcgagaacaccaccaucuggacgucgggguccagcaucuccuucugcggcgucaacagcgacaccgccaacugguccuggcccgacggggccgagcugcccuucaccaucgacaaguga

SEQ ID NO: 18762 - RNA, 1413 nt, Artificial Sequence; identical to SEQ ID NO: 18531
  derived and/or modified CDS sequence (AUadapt) from InfluenzaA__ABY51064__NA

SEQ ID NO: 18763 - RNA, 1413 nt, Artificial Sequence; identical to SEQ ID NO: 18432
  derived and/or modified CDS sequence (AUadapt) from InfluenzaA__ABY51075__NA

SEQ ID NO: 18764 - RNA, 1413 nt, Artificial Sequence
  derived and/or modified CDS sequence (AUadapt) from InfluenzaA__ABY51086__NA
augaaccccaaccagaagaucaucaccaucggcucgaucuccaucgccaucgggaucaucagcaucaugcugcagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggagaaggacaagaccucggucacccucgccgggaacuccagccugugcuccaucucgggcugggccaucuacaccaaggacaacuccauccggaucggcagcaagggggacguguucgugauccgcgagccguucaucuccugcucgcaccuggagugccggacguucuuccucacccagggcgcccugcugaacgacaagcacuccaacgggaccgucaaggaccgcagccccuaccgggcccucauguccugcccccugggcgaggcgcccucgccguacaacagcaaguucgaguccguggccuggagcgccuccgccugccacgacgggaugggcuggcugaccaucggcaucucggggcccgacaacggcgcgguggccguccucaaguacaacgggaucaucacggagaccaucaaguccuggaagaagcgcauccugcggacccaggagagcgagugcgugugcgugaacggcuccugcuucaccaucaugacggacggccccucgaacggggccgccuccuacaagaucuucaagaucgagaagggcaaggucaccaagagcaucgagcugaacgcccccaacuuccacuacgaggagugcuccugcuacccggacaccgggaccgugaugugcgugugccgcgacaacuggcacggcucgaaccggcccugggucuccuucaaccagaaccucgacuaccagaucggguacaucugcagcggcguguucggcgacaacccccgccccaaggacgggaagggcuccugcaacccggugacggucgacggggcggacggcaucaagggguucucguacaaguacggcaacggcguguggaucgggcggaccaaguccaaccgccugcggaagggcuucgagaugaucugggaccccaacggguggaccaacaccgacagcgacuucuccgugaagcaggacgucguggccaucacggacuggucgggcuacagcggguccuucgugcagcaccccgagcugaccggccucgacugcauccgccccugcuucugggucgagcuggugcggggccugccgcgcgagaacaccaccaucuggacgucgggguccagcaucuccuucugcggcgucgacggggacaccgccaacuggagcuggcccgacggcgccgagcuccccuucaccaucgacaaguga

SEQ ID NO: 18765 - RNA, 1413 nt, Artificial Sequence
  derived and/or modified CDS sequence (AUadapt) from InfluenzaA__ABY51097__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccguggagcucaacgcccccaacuuccacuacgaggagugcucgugcuacccggacaccggcaccgugaugugcgucugccgcgacaacuggcacggguccaaccggcccugggugagcuucaaccagaaccuggacuaccagaucggcuacaucugcuccggcguguucggggacaacccccgccccaaggacggcaaggggucgugcaacccggucacgguggacggcgcggacggggugaagggcuucuccuacaaguacggcaacggggucuggaucggccggaccaagagcaaccgccugcggaagggguucgagaugaucugggaccccaacggcuggaccgacaccgacuccgacuucagcgugaagcaggacguggucgccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18766 - RNA, 1413 nt, Artificial Sequence
  derived and/or modified CDS sequence (AUadapt) from InfluenzaA__ABY51108__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacaucguggccaucacggacuggucgggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18767 - RNA, 1413 nt, Artificial Sequence; identical to SEQ ID NO: 18432
  derived and/or modified CDS sequence (AUadapt) from InfluenzaA__ABY51119__NA

SEQ ID NO: 18768 - RNA, 1410 nt, Artificial Sequence; identical to SEQ ID NO: 18286
  derived and/or modified CDS sequence (AUadapt) from InfluenzaA__ABY51130__NA

SEQ ID NO: 18769 - RNA, 1413 nt, Artificial Sequence; identical to SEQ ID NO: 18473
  derived and/or modified CDS sequence (AUadapt) from InfluenzaA__ABY51141__NA

SEQ ID NO: 18770 - RNA, 1413 nt, Artificial Sequence
  derived and/or modified CDS sequence (AUadapt) from InfluenzaA__ABY51152__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcggggugaacuccgacaccgccaacuggagcuggcccgacggcgccgagcugcccuucaccaucgacaaguga

SEQ ID NO: 18771 - RNA, 1413 nt, Artificial Sequence
  derived and/or modified CDS sequence (AUadapt) from InfluenzaA__ABY51163__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucauccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccucgaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacucggacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccucgggcuccagcaucuccuucugcgggguggacagcgacacggccaacugguccuggcccgacggcgccgagcugcccuucaccaucgacaaguga

SEQ ID NO: 18772 - RNA, 1413 nt, Artificial Sequence
  derived and/or modified CDS sequence (AUadapt) from InfluenzaA__ABY51174__NA
augaaccccaaccagaagaugaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccaggugggcuacaucugcucgggcguguucggggacaacccccgccccaaggacggcaagggguccugcaacccgaugacggucgacggcgcggacggggugaagggcuucagcuacaaguacggcaacgggguguggaucggccggaccaaguccaacaagcugcgcaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccggcccugcuucuggguggagcugguccgcgggcucccgcgggagaacaccaccaucuggacgucgggcuccagcaucuccuucugcgggguggacagcgacaccgccaacugguccuggcccgacggcgccgagcugcccuucaccaucgacaaguga

SEQ ID NO: 18773 - RNA, 1413 nt, Artificial Sequence; identical to SEQ ID NO: 18432
  derived and/or modified CDS sequence (AUadapt) from InfluenzaA__ABY51185__NA

SEQ ID NO: 18774 - RNA, 1413 nt, Artificial Sequence; identical to SEQ ID NO: 18467
  derived and/or modified CDS sequence (AUadapt) from InfluenzaA__ABY51196__NA

SEQ ID NO: 18775 - RNA, 1410 nt, Artificial Sequence; identical to SEQ ID NO: 18468
  derived and/or modified CDS sequence (AUadapt) from InfluenzaA__ABY51229__NA

SEQ ID NO: 18776 - RNA, 1413 nt, Artificial Sequence
  derived and/or modified CDS sequence (AUadapt) from InfluenzaA__ABY51240__NA
augaaccccaaccagaagaucaucaccaucggcucgaucuccaucgccaucgggaucaucagccugaugcuccagaucggcaacaucaucuccgugugggccucgcacuccauccagaccgggagccagaaccacacgggcaucugcaaccagcgcaucaucaccuacgagaacuccaccugggucaaccacaccuacgugagcaucaacaacacgaacguggucgcggggaaggacaagaccuccgugacccuggccggcaacucgucccugugcagcaucuccggcuggagcaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugaugagcugcccccugggggaggcccccuccccguacaacagcaaguucgaguccguggcguggucggccuccgccugccacgacggcaugggcuggcucaccaucgggaucagcggccccgacaacggggccgucgcggugcugaaguacaacggcaucaucacggagaccaucaaguccuggaagaagcgcauccugcggacccaggagagcgagugcgugugcgucaacggcuccugcuucaccaucaugacggacgggcccucgaacggcgccgccuccuacaagaucuucaagaucgagaaggggaaggugaccaagagcaucgagcucaacgcccccaacuuccacuacgaggagugcuccugcuacccggacaccggcaccgugaugugcgucugccgcgacaacuggcacgggucgaaccggcccuggguguccuucaaccagaaccuggacuaccagaucggcuacaucugcagcggcguguucggggacaacccccgccccaaggacggcaagggguccugcaacccggucacgguggacggcgccgacggggugaagggcuucagcuacaaguacggcaacggggucuggaucggccggaccaaguccaaccgccugcggaagggguucgagaugaucugggaccccaacggcuggaccgacaccgacucggacuucagcgugaagcaggacguggucgcgaucacggacugguccggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18777 - RNA, 1413 nt, Artificial Sequence; identical to SEQ ID NO: 18458
  derived and/or modified CDS sequence (AUadapt) from InfluenzaA__ABY51251__NA

SEQ ID NO: 18778 - RNA, 1413 nt, Artificial Sequence
  derived and/or modified CDS sequence (AUadapt) from InfluenzaA__ABY51262__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacgccaccaucuggaccuccggcucguccaucagcuucugcgggguggacuccgacacggccaacuggagcuggcccgacggcgccgagcugcccuucaccaucgacaaguga

SEQ ID NO: 18779 - RNA, 1410 nt, Artificial Sequence; identical to SEQ ID NO: 18286
  derived and/or modified CDS sequence (AUadapt) from InfluenzaA__ABY51273__NA

SEQ ID NO: 18780 - RNA, 1350 nt, Artificial Sequence
  derived and/or modified CDS sequence (AUadapt) from InfluenzaA__ABY76285__NA
augaaucccaaccaaaagaucaucaccaucggcagcaucugcauggugaucgggaucgucucccugaugcuccagaucggcaacaugaucagcaucugggugucccacaguauccagaccgggaaccagcgccaggccgagccgaucuccaacacgaaguuccugaccgagaaggccguggcgagcgucacccuggccggcaacuccagccucugccccaucuccgggugggccguguauagcaaggacaacuccauccggaucggcagcaagggcgacguguucgucauccgcgagcccuucaucuccuguagccaccuggagugccggaccuucuuccugacgcagggggcccuccugaacgacaagcauuccaacggcaccgugaaggaccgcagcccccaccggacccugauguccugcccggugggggaggcccccagccccuacaauucccgcuucgagagcgucgcguggagcgccuccgccugccacgacggcaccagcuggcucacgaucgggaucuccggccccgauaacggcgccguggcggugcugaaguacaacgggaucaucaccgacaccaucaagagcuggcggaacaacauccugcgcacccaggaguccgagugugccugcgucaacggcagcugcuucacggugaugaccgacgggccguccaacggccaggccaguuacaagaucuucaaaauggagaagggcaagguggucaaguccguggagcucgacgcccccaacuaccacuaugaggagugcagcugcuaccccgacgccggggagaucacgugcgugugccgggauaacuggcacggcuccaaccgccccugggucagcuucaaccagaaccuggaguaucagaucggguacaucugcuccggcguguucggggacaacccgcggcccaacgacggcaccggcaguugcgggcccgugucccccaacggcgcguacggggucaagggcuucagcuucaaguacgggaauggcguguggaucggccgcaccaaguccaccaacagccgguccggguucgagaugaucugggacccgaacggcuggaccgggaccgacagcaguuucuccgugaagcaggacaucgucgccaucacggacuggagcggcuacuccgggagcuucgugcagcaucccgagcugaccggccucgacugcauccgccccugcuucugggucgagcugauccggggccgccccaaggaguccaccaucuggaccagcggguccagcaucuccuucuguggcgugaacagcgacacgguguccuggagcuggccggacggggccgagcugcccuucaccaucgacaaguga

SEQ ID NO: 18781 - RNA, 1413 nt, Artificial Sequence
  derived and/or modified CDS sequence (AUadapt) from InfluenzaA__ABY81352__NA
augaaccccaaccagaagaucaucaccaucggcucgaucugcauggccaucgggaucaucucccugauccuccagaucggcagcaucaucuccaucugggugucgcacuccauccagaccgggagccagaaccacacgggcaucugcaaccagcgcaucaucaccuacgagaacuccaccugggucaaccagaccuacgugaacaucagcaacacgaacguggucgccgggaaggacaccaccuccaugacccuggcgggcaacucgucccugugcccgauccggggcugggccaucuacagcaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggagccccuaccgcgcccugauguccugccccaucggggaggccccgucgcccuacaacagccgguucgaguccguggcguggagcgccuccgccugccacgacggcaugggcuggcugaccaucgggaucucgggccccgacgacggggccguggcgguccucaaguacaacggcaucaucacggagaccaucaaguccuggcgcaagcagauccugcggacccaggagagcgagugcgugugcgugaacggcuccugcuucaccaucaugacggacgggcccagcgacggccaggccuccuaccgcaucuucaagaucgagaaggggaagaucaccaagucgaucgagcuggacgccccgaacucccacuacgaggagugcagcugcuaccccgacaccggcaccgucaugugcgugugccgggacaacuggcacggguccaaccgccccugggugucguucaaccagaaccucgacuaccagaucggcuacaucugcuccggcgucuucggggacaacccccggccgaaggacggcaaggggagcugcgaccccgugaacguggacggcgccgacggggucaagggcuucuccuaccgcuacggcaacgggguguggaucggccggaccaagagcaacuccucgcgcaagggguucgagaugaucugggaccccaacggcuggacggacaccgacagcaacuuccuggugaagcaggacgucguggccaugaccgacugguccggguacagcggcuccuucgugcagcaccccgagcugacgggccucgacugcaugcggccgugcuucugggucgagcugauccgcgggcggccccgcgagaagaccaccaucuggaccucgggcuccagcaucuccuucugcggggugaacagcgacacggucaacugguccuggcccgacggcgcggagcugcccuucaccaucgacaaguga

SEQ ID NO: 18782 - RNA, 1413 nt, Artificial Sequence
  derived and/or modified CDS sequence (AUadapt) from InfluenzaA__ABY81363__NA
augaaccccaaccagaagaucaucaccaucggcucgaucuccaucgccaucgggaucaucagccugaugcuccagaucggcaacaucaucuccaucugggccucgcacuccauccagaucgggagccagaaccacaccggcaucugcaaccagcgcaucaucacguacgagaacuccaccugggugaaccacaccuacgucagcaucaacaacaccaacgugguggcggggaaggacaagacguccgucacccuggccggcaacucgucccugugcagcaucuccggcugggccaucuacaccaaggacaacagcauccggaucggguccaagggcgacguguucgugauccgcgagccguucaucucgugcucccaccucgagugccggaccuucuuccugacgcagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucaccgagacgaucaagagcuggaagaagcgcauccugcggacccaggaguccgagugcgugugcgugaacggcagcugcuucaccaucaugaccgacgggcccuccaacggcgccgccucguacaagaucuucaagaucgagaaggggaaggucacgaaguccaucgagcucaacgcccccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggacggacaccgacuccgacuucucggucaagcaggacgugguggccaucaccgacuggagcggguacuccggcagcuucguccagcaccccgagcucacgggccuggacugcauccgccccugcuucuggguggagcugguccgggggcucccgcgcgagaacaccaccaucuggaccuccggcucguccaucagcuucugcgggguggacuccgacacggccaacuggagcuggcccgacggcgccgagcugcccuucaccaucgacaaguga

SEQ ID NO: 18783 - RNA, 1410 nt, Artificial Sequence; identical to SEQ ID NO: 18468
  derived and/or modified CDS sequence (AUadapt) from InfluenzaA__ABY81374__NA

SEQ ID NO: 18784 - RNA, 1413 nt, Artificial Sequence; identical to SEQ ID NO: 18432
  derived and/or modified CDS sequence (AUadapt) from InfluenzaA__ABY81385__NA

SEQ ID NO: 18785 - RNA, 1413 nt, Artificial Sequence
  derived and/or modified CDS sequence (AUadapt) from InfluenzaA__ABY81407__NA
augaaccccaaccagaagaucaucaccaucggcucgaucuccaucgccaucgggaccaucagccugaugcuccagaucggcaacaucaucuccaucugggccucgcacuccauccagacggggagccagaaccacaccggcaucugcaaccagcgcaucaucaccuacgagaacuccaccugggugaaccacacguacgucucgaucaacaacaccaacgugguggcggggaaggacaagaccuccgucacccuggccggcaacagcucccugugcagcaucuccggcugggccaucuacacgaaggacaacucgauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcgcccucgccguacaacuccaaguucgagagcguggccugguccgccagcgccugccacgacggcaugggcuggcucacgaucgggaucuccggccccgacaacggggcgguggccguccugaaguacaacggcaucaucaccgagaccaucaagucguggaagaagcgcauccugcggacccaggaguccgagugcgugugcgugaacggcagcugcuucacgaucaugaccgacgggcccuccaacggcgccgccucguacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugaccgucgacggcgcggacggggugaagggcuucuccuacaaguacggcaacgggguguggaucggccggaccaagagcaaccgccugcggaagggguucgagaugaucugggaccccaacggcuggaccgacacggacuccgacuuccucgucaagcaggacgugguggccaucaccgacuggucgggguacagcggcuccuucguccagcaccccgagcugaccggccuggacugcauccgccccugcuucuggguggagcucguccgggggcugccgcgcgagaacaccacgaucuggaccucgggcuccagcaucuccuucugcgggguggacagcgacaccgccaacugguccuggcccgacggcgccgagcugcccuucaccaucgacaaguga

SEQ ID NO: 18786 - RNA, 1410 nt, Artificial Sequence; identical to SEQ ID NO: 18468
  derived and/or modified CDS sequence (AUadapt) from InfluenzaA__ACA24505__NA

SEQ ID NO: 18787 - RNA, 1413 nt, Artificial Sequence; identical to SEQ ID NO: 18432
  derived and/or modified CDS sequence (AUadapt) from InfluenzaA__ACA24516__NA

SEQ ID NO: 18788 - RNA, 1413 nt, Artificial Sequence; identical to SEQ ID NO: 18432
  derived and/or modified CDS sequence (AUadapt) from InfluenzaA__ACA24527__NA

SEQ ID NO: 18789 - RNA, 1410 nt, Artificial Sequence
  derived and/or modified CDS sequence (AUadapt) from InfluenzaA__ACA24692__NA
augaaccccaaccagaagaucaucaccaucggcucggugucccugaccaucagcacgaucugcuucuucaugcagaucgccauccucaucaccaccgucacccugcacuucaagcaguacgaguucuccccgccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccccagugcgacaucaccggguucgcgcccuucuccaaggacaacagcauccgccuguccgccggcggggacaucugggucacccgggagcccuacgugucgugcgacccggacaagugcuaccaguucgcccucggccaggggaccacgcugaacaacgugcacuccaacgacaccguccacgaccgcacccccuaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuacccgggcguccggugcgugugccgcgacaacuggaaggggagcaaccggcccaucguggacaucaacaucaaggacuacuccaucgucucgaaguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagucccgcucgggcuacgagaccuucaaggucaucgagggguggagcaacccgaacuccaagcugcagaucaaccgccaggugaucguggaccggggcaaccggucgggguacuccggcaucuucagcgucgagggcaagucgugcaucaaccgcugcuucuacguggagcugauccgggggcgcaacgaggagaccgaggugcucuggaccuccaacagcaucgucguguucugcggcaccuccgggacguacggcaccgggagcuggcccgacggcgccgacaucaaccugaugcccaucuga

SEQ ID NO: 18790 - RNA, 1410 nt, Artificial Sequence
  derived and/or modified CDS sequence (AUadapt) from InfluenzaA__ACA24703__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaucaccaucgagaaggagacgugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaacgccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 18791 - RNA, 1413 nt, Artificial Sequence
  derived and/or modified CDS sequence (AUadapt) from InfluenzaA__ACA33539__NA
augaaccccuaccagaagaucaucaccaucggcucgaucuccaucgccaucgggaucaucagccugaugcuccagaucggcaacaucaucuccaucugggccagccacuccauccagaccgggucgcagaaccacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcucgugcuucaccaucaugacggacgggcccuccaacggcgccgccagcuacaagaucuucaagaucgagaaggggaaggucaccaaguccaucgagcucaacgcccccaacuucuacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucucggucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18792 - RNA, 1413 nt, Artificial Sequence
  derived and/or modified CDS sequence (AUadapt) from InfluenzaA__ACA33540__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccucguacaagaucuucaagaucgagaaggggaaggucaccaaguccaucgagcucaacgcccccaacuucuacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucucggucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18793 - RNA, 1413 nt, Artificial Sequence
  derived and/or modified CDS sequence (AUadapt) from InfluenzaA__ACA33582__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccucguacaagaucuucaagaucgagaaggggaaggucaccaaguccaucgagcucaacgcccccaacuucuacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccgaugacgguggacggcgcggacggggucaagggcuucuccuacaaguacggcaacgggguguggaucggccggaccaagagcaaccgccugcggaagggguucgagaugaucugggaccccaacggcuggaccgacaccgacuccgacuucucggugaagcaggacgucguggccaucacggacuggagcggguacuccggcagcuucgugcagcaccccgagcucaccggccuggacugcauccgccccugcuucugggucgagcuggugcgggggcucccgcgcgagaacaccaccaucuggacguccggcucguccaucagcuucugcggggucgacuccgacaccgccaacuggagcuggcccgacggcgccgagcugcccuucaccaucgacaaguga

SEQ ID NO: 18794 - RNA, 1413 nt, Artificial Sequence
  derived and/or modified CDS sequence (AUadapt) from InfluenzaA__ACA33622__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuacaagaucuucaagaucgagaaggggaaggucaccaagagcaucgagcucaacgcccccaacuucuacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccaacaccgacucggacuucuccgucaagcaggacgugguggccaucacggacuggagcggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18795 - RNA, 1413 nt, Artificial Sequence; identical to SEQ ID NO: 18471
  derived and/or modified CDS sequence (AUadapt) from InfluenzaA__ACA96522__NA

SEQ ID NO: 18796 - RNA, 1362 nt, Artificial Sequence
  derived and/or modified CDS sequence (AUadapt) from InfluenzaA__ACC55274__NA
augaaucccaaccagaagaucaucaccaucggcucggugucccugaccaucgccacggucugcuuccucaugcagaucgccauccuggcgaugaccgugacccugcacuuccgccagaaugagugcagcaucuccgccaacagccagguggucccgugcgagcccaccacggagaaggaggugugcuccaagguggucgacuaucggagcugguccaagccccagugccagaucaccggguucgcccccuucagcaaggacaacuccauccgccucagugccggcggggacaucuggaucacccgggagccguacguguccugcgacaccagcaagugcuaccaguuugcccugggccaggggacgacccuggacaacgagcacuccaacggcaccauccacgaccgcaucccccaucggacccuccugaugaacgagcugggcgugcccuuccaccucgggacgcgccaggucugcaucgcguggagcuccagcuccugccaugacggcaaggccuggcugcacgugugcgugaccggggacgaccggaacgccaccgccagcuuuaucuacaacggcaugcuggucgacuccaucgggagcuggagccagaacauccuccgcacccaggaguccgagugcguguguaucaacggcagcugcacgguggucaugaccgacggcuccgcgagcgggaaggccgacacccggauccuguucgugaaggagggcaagaucgugcauaucucgccccuguccggguccgcccagcacaucgaggagugcagcugcuacccgcgcuaucccaacguccggugcgugugccgcgacaacuggaagggcuccaaccggcccgugaucgacaucaauaugaccgacuacagcaucgacuccagcuacgucugcuccggccucgugggggauacgccccgcaacgaggacagcuccagcuccagcaacugccgggauccgaacgaggagcgcggcaaccccggggugaagggcugggccuucgacuccggggacgacgucuggaugggccggaccaucagucgcgacagccgguccggcuacgagaccuuccgcgugaucgggggcuggaccacggccaacagcaagucccagaccaaccggcaggucaucguggauaacaacaacuggagcggguacuccggcaucuucagcguggagcauaaguccugcaucaaccgcugcuucuacgucgagcugauccgcgggcggcccaaggagacccgcgugugguggaccagcaacuccaucguggucuuuugcggcacgagcggcaccuacgggaccggcuccuggcccgacggggcgaacaucaacuucaugccgaucuga

SEQ ID NO: 18797 - RNA, 1413 nt, Artificial Sequence; identical to SEQ ID NO: 18731
  derived and/or modified CDS sequence (AUadapt) from InfluenzaA__ACC61967__NA

SEQ ID NO: 18798 - RNA, 1413 nt, Artificial Sequence
  derived and/or modified CDS sequence (AUadapt) from InfluenzaA__ACD11077__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggugaccaccucgaugacccuggcgggcaacuccagccugugcccgauccggggcugggccaucuacuccaaggacaacagcauccgcaucggguccaagggcgacguguucgucauccgggagcccuucaucucgugcucccaccucgagugccgcacguucuuccugacccagggggcccugcucaacgacaagcacagcaacggcaccgugaaggaccggucccccuaccgcgcccugaugucgugccccaucggggaggccccgucccccuacaacagccgguucgagucgguggcgugguccgccagcgccugccacgacggcaugggcuggcugaccaucgggaucuccggccccgacgacggggccgucgcggugcucaaguacaacggcaucaucacggagaccaucaagagcuggcgcaagcagauccugcggacccaggaguccgagugcgugugcgucaacggcucgugcuucaccaucaugacggacgggcccuccgacggcccggccagcuaccgcaucuucaagaucgagaaggggaagaucaccaaguccaucgagcuggacgcccccaacucgcacuacgaggagugcuccugcuaccccgacaccggcaccgugaugugcgugugccgggacaacuggcacgggagcaaccgccccugggucuccuucaaccagaaccucgacuaccagaucggcuacaucugcucgggcguguucggggacaacccgcggcccaaggacggcaagggguccugcgaccccgugaacgucgacggcgccgacggggugaagggcuucagcuaccgcuacggcaacgggguguggaucggccggacgaaguccaacaacagccgcaagggguucgagaugaucugggaccccaacggcuggaccgacaccgacuccaacuuccuggucaagcaggacgugguggccaugaccgacuggucgggguacagcggcuccuucguccagcacccggagcugacgggccucgacugcaugcggcccugcuucuggguggagcugauccgcgggcggccccgcgagaagaccaccaucuggaccucgggcuccagcaucuccuucugcggggucaacagcgacacggugaacugguccuggcccgacggcgcggagcugccgcucaccaucgacaaguga

SEQ ID NO: 18799 - RNA, 1413 nt, Artificial Sequence
  derived and/or modified CDS sequence (AUadapt) from InfluenzaA__ACD11078__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacucgauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugucgugccccaucggggaggccccgucccccuacaacagccgguucgagucgguggcgugguccgccagcgccugccacgacggcaugggcuggcugaccaucgggaucuccggccccgacgacggggccguggcgguccucaaguacaacggcaucaucacggagaccaucaagucguggcgcaagcagauccugcggacccaggaguccgagugcgugugcgugaacggcagcugcuucaccaucaugacggacgggcccuccgacggcccggccucguaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggagcaaccgccccuggguguccuucaaccagaaccucgacuaccagaucggcuacaucugcucgggcgucuucggggacaacccgcggcccaaggacggcaagggguccugcgaccccgugaacguggacggcgccgacggggucaagggcuucagcuaccgcuacggcaacgggguguggaucggccggacgaaguccaacucgucccgcaagggguucgagaugaucugggaccccaacggcuggaccgacaccgacagcaacuuccuggugaagcaggacgucguggccaugaccgacuggucgggguacuccggcagcuucgugcagcacccggagcugacgggccucgacugcaugcggcccugcuucugggucgagcugauccgcgggcggccccgcgagaagaccaccaucuggaccuccggcucguccaucagcuucugcggggugaacuccgacacggucaacuggagcuggcccgacggcgcggagcugccgcucaccaucgacaaguga

SEQ ID NO: 18800 - RNA, 1413 nt, Artificial Sequence
  derived and/or modified CDS sequence (AUadapt) from InfluenzaA__ACD11079__NA
augaaccccaaccagaagaucaucaccaucggcucgaucugcauggccaucgggaucaucucccugauccuccagaucggcaacaucaucagcaucugggugucccacucgauccagaccgggucccagaaccacacgggcaucugcaaccagcgcaucaucaccuacgagaacagcaccugggucaaccagaccuacgugaacaucuccaacacgaacguggucgccgggaaggacaccaccucgaugacccuggcgggcaacuccagccugugcccgauccggggcugggccaucuacuccaaggacaacucgauccgcaucggguccaagggcgacguguucgugauccgggagcccuucaucagcugcucccaccucgagugccgcacguucuuccugacccagggggcccugcucaacgacaagcacagcaacggcaccgucaaggaccggucccccuaccgcgcccugaugucgugccccaucggggaggccccgucccccuacaacagccgguucgagucgguggcgugguccgccagcgccugccacgacggcaugggcuggcugaccaucgggaucuccggccccgacgacggggccguggcggucaucaaguacaacggcaucaucacggagaccaucaagucguggcgcaagcagauccuccggacccaggaguccgagugcgugugcgugaacggcagcugcuucaccaucaugacggacgggcccuccgacggcccggccucguaccgcaucuucaagaucgagaaggggaagaucaccaaguccaucgagcuggacgcccccaacagccacuacgaggagugcuccugcuaccccgacaccggcaccgucaugugcgugugccgggacaacuggcacgggagcaaccgccccuggguguccuucaaccagaaccuggacuaccagaucggcuacaucugcucgggcgucuucggggacaacccgcggcccaaggacggcaagggguccugcgaccccgugaacguggacggcgccgacggggucaagggcuucagcuaccgcuacggcaacgggguguggaucggccggacgaaguccaacucgucccgcaagggguucgagaugaucugggaccccaacggcuggaccgacaccgacagcaacuuccucgugaagcaggacgucguggccaugaccgacuggucgggguacuccggcagcuucgugcagcacccggagcugacgggccuggacugcaugcggcccugcuucugggucgagcucauccgcgggcggccccgcgagaagaccaccaucuggaccuccggcucguccaucagcuucugcggggugaacuccgacacggucaacuggagcuggcccgacggcgcggagcugccgcugaccaucgacaaguga

SEQ ID NO: 18801 - RNA, 1413 nt, Artificial Sequence; identical to SEQ ID NO: 18432
  derived and/or modified CDS sequence (AUadapt) from InfluenzaA__ACD56116__NA

SEQ ID NO: 18802 - RNA, 1413 nt, Artificial Sequence; identical to SEQ ID NO: 18432
  derived and/or modified CDS sequence (AUadapt) from InfluenzaA__ACD56127__NA

SEQ ID NO: 18803 - RNA, 1410 nt, Artificial Sequence; identical to SEQ ID NO: 18286
  derived and/or modified CDS sequence (AUadapt) from InfluenzaA__ACD56261__NA

SEQ ID NO: 18804 - RNA, 1410 nt, Artificial Sequence
  derived and/or modified CDS sequence (AUadapt) from InfluenzaA__ACD56272__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucucccgcuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 18805 - RNA, 1413 nt, Artificial Sequence
  derived and/or modified CDS sequence (AUadapt) from InfluenzaA__ACD56283__NA
augaaccccaaccagaagaucaucaccaucggcucgaucuccauggccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacgugguggcggggaaggacaagaccuccgucacccuggccggcaacagcucccugugcagcaucuccggcugggccaucuacaccaaggacaacucgauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacggagaccaucaagucguggaagaagcgcauccugcggacccaggaguccgagugcgugugcgugaacggcagcugcuucaccaucaugacggacgggcccuccaacggcgccgccagcuacaagaucuucaagaucgagaaggggaaggucaccaaguccaucgagcucaacgcccccaacuuccacuacgaggagugcucgugcuacccggacaccggcaccgugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucagcgucaagcaggacgugguggccaucacggacuggucgggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgccaacuggagcuggcccgacggcgccgagcugcccuucaccaucgacaaguga

SEQ ID NO: 18806 - RNA, 1410 nt, Artificial Sequence
  derived and/or modified CDS sequence (AUadapt) from InfluenzaA__ACD56305__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggucguccucguccugccacgacggcaaggcguggcugcacgucugcgugaccggggacgacaagaacgccaccgccagcuucaucuacgacggccggcucguggacuccaucgggucguggucccagaacauccugcgcacgcaggagagcgagugcgucugcaucaacgggaccugcaccguggugaugaccgacggcuccgccucggggcgggcggacacgcgcauccuguucaucgaggagggcaagaucguccacaucucgccccucuccgggagcgcccagcacguggaggagugcuccugcuacccccgguacccggacgugcgcugcaucugccgggacaacuggaagggcucgaaccgccccgucaucgacaucaacauggaggacuacuccaucgacagcuccuacgugugcucgggccuggugggggacacgccccggaacgacgaccgcuccucgaacuccaacugccgggaccccaacaacgagcgcggcaacccgggggucaagggcugggccuucgacaacggggacgacguguggaugggccggaccaucagcaaggaccugcgcuccggcuacgagaccuucaaggucaucgggggcuggucgacccccaacuccaagagccagaucaaccgccaggugaucguggacuccaacaacuggucgggguacuccggcaucuucucggucgagggcaagagcugcaucaaccggugcuucuacguggagcucauccgcggccggcagcaggagacccgcgugugguggaccuccaacucgaucgucguguucugcggcaccuccgggacguacggcaccgggagcuggcccgacggcgccaacaucaacuucaugcccaucuga

SEQ ID NO: 18807 - RNA, 1410 nt, Artificial Sequence
  derived and/or modified CDS sequence (AUadapt) from InfluenzaA__ACD56316__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccgagguggucgaguaccggaacuggagcaagccgcagugccagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggagcuccucguccugccacgacggcaaggcguggcugcacgucugcgugaccggggacgacaagaacgccaccgccagcuucaucuacgacggccggcucauggacuccaucgggucguggucccagaacauccugcgcacgcaggagucggagugcgugugcaucaacgggaccugcaccgucgugaugaccgacggcuccgccagcggccgggcggacacgcgcauccuguucaucgaggagggcaagaucgugcacaucucgccccucuccgggucggcccagcacgucgaggagugcuccugcuacccccgguacccggacgugcgcugcaucugccgggacaacuggaagggcagcaaccgccccgugaucgacaucaacauggaggacuacuccaucgacucguccuacgucugcagcggccuggugggggacacgccccggaacgacgaccgcuccucgaacuccaacugccggaaccccaacaacgagcgcggcaacccgggggugaagggcugggccuucgacaacggggacgacgucuggaugggccggaccaucucgaaggaccugcgcuccggcuacgagaccuucaaggugaucgggggcuggagcacccccaacuccaagucgcagaucaaccggcaggucaucguggacuccaacaacuggucgggguacuccggcaucuucagcguggaggggaagcgcugcaucaaccgcugcuucuacgucgagcucauccggggccgccagcaggagacccgggugugguggaccucgaacuccaucguggucuucugcggcaccagcgggacguacggcaccggguccuggcccgacggcgccaacaucaacuucaugcccaucuga

SEQ ID NO: 18808 - RNA, 1410 nt, Artificial Sequence
  derived and/or modified CDS sequence (AUadapt) from InfluenzaA__ACD56327__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccuccaagugccaccaguucgcccugggccaggggaccacccucgagaacaagcacagcaacggcaccaagcacgaccgcaucccgcaccggacgcugcugaugaacgagcucggcgugcccuuccaccuggggaccaagcaggucugcguggcgugguccucguccagcugccacgacggcaaggccuggcugcacgugugcgucaccggggacgaccgcaacgccaccgccuccuucaucuacggcgggcggcucguggacucgaucguguccuggucgcagaacauccugcgcacgcaggaguccgagugcgucugcaucaacgggaccugcaccguggugaugaccgacggcagcgcgucgggccgggccgacacgcgcauccuguucaucaaggagggcaagaucguccacaucagcccccucuccggguccgcccagcacaucgaggagugcucgugcuacccccgguacccggacgugcgcugcaucugccgggacaacuggaagggcuccaaccgccccgugaucgacaucaacauggaggacuacucgaucgacuccagcuacgucugcuccggccuggugggggacacgccccggaacgacgacucguccucgaacuccaacugccgcgaccccaacaacgagcggggcaacccgggggugaagggcugggccuucgacaacggggacgacgucuggaugggccgcaccaucagcaaggacucccggucgggcuacgagaccuucaaggugaucgggggcugguccacccccaacagcaagucccaggucaaccgccaggugaucguggacucgaacaacuggucgggguacuccggcaucuucagcgucgaggggaaguccugcaucaaccggugcuucuacguggagcugauccgcggccgcccccaggagacccgggugugguggaccucgaacuccaucgucguguucugcggcaccagcgggacguacggcaccggguccuggcccgacggcgccaacaucaacuucaugccgaucuga

SEQ ID NO: 18809 - RNA, 1410 nt, Artificial Sequence
  derived and/or modified CDS sequence (AUadapt) from InfluenzaA__ACD85190__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggucguccucguccugccacgacggcaaggcguggcugcacgugugcgucaccggggacgacaagaacgccaccgccagcuucaucuacgacggccggcucguggacuccaucgggucguggucccagaacauccugcgcacgcaggagagcgagugcgugugcaucaacgggaccugcaccgucgugaugaccgacggcuccgccucggggcgggcggacacgcgcauccuguucaucgaggagggcaagaucgugcacaucucgccccucuccgggagcgcccagcacgucgaggagugcuccugcuacccccgguacccggacgugcgcugcaucugccgggacaacuggaagggcucgaaccgccccaucaucgacaucaacauggaggacuacuccaucgacagcuccuacgugugcucgggccuggucggggacacgccccggaacgacgaccgcuccucgaacuccaacugccggaaccccaacaacgagcgcggcaacccgggggugaagggcugggccuucgacaacggggacgacguguggaugggccggaccaucagcaaggaccugcgcuccggcuacgagaccuucaaggucaucgggggcuggucgacccccaacuccaagagccagaucaaccgccaggugaucgucgacuccaacaacuggucgggguacuccggcaucuucucgguggagggcaagagcugcaucaaccggugcuucuacguggagcucauccgcggccggcagcaggagacccgcgucugguggaccuccaacucgaucgugguguucugcggcaccuccgggacguacggcaccgggagcuggcccgacggcgccaacaucaacuucaugcccaucuga

SEQ ID NO: 18810 - RNA, 1410 nt, Artificial Sequence
  derived and/or modified CDS sequence (AUadapt) from InfluenzaA__ACD85201__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggucguccagcuccugccacgacggcaaggcguggcugcacgugugcgucaccggggacgacaagaacgccaccgccucguucaucuacgacggccggcucguggacuccaucucguccuggagccagaacauccugcgcacgcaggaguccgagugcgugugcaucaacgggaccugcaccgucgugaugaccgacggcucggccagcggccgggcggacacgcgcauccuguucaucgaggaggggaagaucgugcacaucucgccccucuccggcuccgcccagcacgucgaggagugcagcugcuacccccgguacccggacgugcgcugcaucugccgggacaacuggaagggguccaaccgccccgugaucgacaucaacauggaggacuacucgaucgacuccagcuacgucugcuccggccuggugggcgacacgccccggaacgacgaccgcucguccaacucgaacugccggaaccccaacaacgagcgcgggaacccgggcgugaaggggugggccuucgacaacggcgacgacgucuggauggggcggaccaucuccaaggaccugcgcagcggcuacgagaccuucaaggugaucggcgggugguccacccccaacucgaagucccagaucaaccggcaggucaucguggacagcaacaacugguccggcuacucggggaucuucagcguggagggcaaguccugcaucaaccgcugcuucuacgucgagcucauccgcgggcggcagcaggagacccgcgugugguggaccucgaacuccaucguggucuucugcggcaccagcggcacguacgggaccggcuccuggcccgacggggccaacaucaacuucaugcccaucuga

SEQ ID NO: 18811 - RNA, 1410 nt, Artificial Sequence
  derived and/or modified CDS sequence (AUadapt) from InfluenzaA__ACD85212__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucaaggagaucgucuaccucaacaacacgaccaucgagaaggagaucugccccgaggugguggaguaccggaacuggucgaagccgcagugccagaucaccggguucgcccccuucuccaaggacaacagcauccgccuguccgccggcggggacaucugggucacccgggagcccuacgugucgugcgaccccggcaagugcuaccaguucgcccuggggcagggcacgacccucgacaacaagcacuccaacggcaccauccacgaccgcaucccgcaccggacccugcugaugaacgagcucggggugcccuuccaccugggcacgaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacccaggagagcgagugcgugugcaucaacggcacgugcaccgucgugaugaccgacggguccgcgucgggccgggccgacacccgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcagcgggcuggucggcgacacgccccggaacgacgacuccucguccaacucgaacugccgcgaccccaacaacgagcgggggaacccgggcgugaaggggugggccuucgacaacggcgacgacguguggaugggccgcaccaucaacaaggacucccggagcggguacgagaccuucaaggucaucggcgggugguccacccccaacucgaagucccaggugaaccgccaggucaucguggacaacaacaacuggucgggcuacuccgggaucuucagcguggagggcaagucgugcaucaaccggugcuucuacgucgagcugauccgcggccgcccccaggagacgcgggugugguggaccuccaacucgaucguggucuucugcgggaccuccggcaccuacgggacgggcagcuggcccgacggggccaacaucaacuucaugccgaucuga

SEQ ID NO: 18812 - RNA, 1410 nt, Artificial Sequence
  derived and/or modified CDS sequence (AUadapt) from InfluenzaA__ACD85223__NA
augaaccccaaccagaagaucaucaccaucggcucggugucccugaccaucgccacggccugcuuccucaugcagaucgcgauccuggucaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccaaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcaucgcguggagcuccucguccugccacgacggcaaggccuggcugcacgugugcgugaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgcgucggggcgggccgacacgcgcauccuguucaucgaggagggcaagaucgugcacaucagcccccucuccgggucggcccagcacguggaggagugcuccugcuacccccgguacccggacguccgcugcaucugccgggacaacuggaagggcagcaaccgccccaucaucgacaucaacauggaggacuacuccaucgacucguccuacgugugcucgggccuggugggggacacgccccggaacgacgaccgcuccagcaacuccaacugccggaaccccaacaacgagcgcggcaacccgggggucaagggcugggccuucgacaacggggacgacguguggaugggccggaccaucucgaaggaccugcgcuccggcuacgagaccuucaaggugaucgggggcuggucgacccccaacuccaagagccagaucaaccggcaggucaucguggacuccaacaacuggucgggguacuccggcaucuucucggucgagggcaagagcugcaucaaccgcugcuucuacguggagcucauccgcggccggcagcaggagacccgcgugugguggaccuccaacucgaucgucguguucugcggcaccuccgggacguacggcaccgggagcuggcccgacggcgccaacaucaacuucaugcccaucuga

SEQ ID NO: 18813 - RNA, 1410 nt, Artificial Sequence
  derived and/or modified CDS sequence (AUadapt) from InfluenzaA__ACD85234__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccgacggcgacaucugggucacgcgggagcccuacgugucgugcgaccccgggaagugcuaccaguucgcccugggccaggggaccacccucgacaacaagcacuccaacggcaccauccacgaccgcaucccgcaccggacgcugcugaugaacgagcucggcgugcccuuccaccuggggaccaagcaggucugcguggcguggagcuccucguccugccacgacggcaaggccuggcugcacgugugcgucaccggggacgaccgcaacgccaccgccucguucaucuacgacggccggcucguggacuccaucgggagcuggucccagaacauccugcgcacgcaggagucggagugcgugugcaucaacgggaccugcaccgucgugaugaccgacggcuccgcgucggggcgggccgacacgcgcauccuguucaucaaggagggcaagaucgugcacaucagcccccucuccgggucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcucgggccuggucggggacacgccccggaacgacgacuccagcuccaacucgaacugccgcgaccccaacaacgagcggggcaacccgggggugaagggcugggccuucgacaacggggacgacguguggaugggccgcaccaucuccaaggaccugcggucgggcuacgagaccuucaaggucaucgggggcugguccacccccaacagcaagucccaggugaaccgccaggucaucguggacaacaacaacuggucgggguacuccggcaucuucucgguggagggcaagagcugcaucaaccggugcuucuacgucgagcucauccgcggccgcccccaggagacccgggugugguggaccuccaacucgaucguggucuucugcggcaccuccgggacguacggcaccgggagcuggcccgacggcgccaacaucaacuucaugccgaucuga

SEQ ID NO: 18814 - RNA, 1410 nt, Artificial Sequence
  derived and/or modified CDS sequence (AUadapt) from InfluenzaA__ACD85245__NA
augaaccccaaccagaagaucaucaccaucggcucggugucccugaucaucgccaccgucugcuuccucaugcagaucgccauccuggugacgaccgugacccugcacuucaagcagcacgagugcgacucgccggcguccaaccaggucaugcccugcgagcccaucaucaucgagcgcaacaucaccgagaucguguaccucaacaacacgaccaucgagaaggagaucugcccccggguggucgaguaccgcaacuggagcaagccgcagugccagaucaccggguucgcccccuucuccaaggacaacucgauccggcuguccgccggcggggacaucugggugacccgcgagcccuacgugagcugcgaccccggcaagugcuaccaguucgcccuggggcagggcacgacccucgacaacaagcacuccaacgacaccauccacgaccggaucccgcaccgcacccugcugaugaacgagcucggcguccccuuccaccuggggacgcgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcggacccaggagagcgagugcgugugcaucaacggcacgugcaccguggucaugaccgacggcuccgccucggggcgcgcggacacccggauccuguucaucgaggagggcaagaucgugcacaucucgccccucuccgggagcgcccagcacguggaggagugcuccugcuacccccgcuacccgggcguccggugcaucugccgcgacaacuggaagggcucgaaccggcccgugguggacaucaacauggaggacuacuccaucgacagcuccuacgucugcucggggcuggugggcgacacgccccgcaacgacgaccgguccucgaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggucgaccccgaacuccaagagccagaucaaccgccaggucaucguggacuccgacgaccgcucgggcuacuccgggaucuucucgguggagggcaagagcugcaucaaccggugcuucuacgucgagcucauccgcggccggaagcaggagacgcgcgugugguggaccuccaacucgaucguggucuucugcgggaccuccggcaccuacgggacgggcagcuggcccgacggggccaacaucaacuucaugcccaucuga

SEQ ID NO: 18815 - RNA, 1410 nt, Artificial Sequence
  derived and/or modified CDS sequence (AUadapt) from InfluenzaA__ACD85454__NA
augaaccccaaccagaagaucaucaccaucggcucggugucccugaccaucucgacgaucggguucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacucgauccgccuguccgccgggggcgacaucugggucacccgggagcccuacgugagcugcgaccccgacaagugcuaccaguucgcccucgggcagggcacgacccugaacaacgugcacuccaacgacaccguccgcaaccggaccccguaccgcacgcugcucaugaacgagcugggcgugcccuuccaccuggggaccaagcaggucugcaucgccuggucguccagcuccugccacgacggcaaggccuggcuccacgugugcaucaccggggacgacaagaacgcgaccgccucguucaucuacaacggccggcugguggacuccaucgugucgugguccaaggagauccugcgcacgcaggagagcgagugcgucugcaucaacgggaccugcaccguggugaugaccgacggcuccgccucgggcaaggccgacacgaagauccucuucaucgaggaggggaagaucguccacaccagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccucgucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcugcagaucaaccgccaggucaucguggaccgggggaaccgcagcggcuacuccgggaucuucucgguggagggcaagagcugcaucaaccggugcuucuacgucgagcucauccgcggccggaaggaggagaccgaggugcuguggaccuccaacucgaucguggucuucugcgggacguccggcaccuacgggaccggcagcuggccggacggggccgacaucaaccugaugcccaucuga

SEQ ID NO: 18816 - RNA, 1410 nt, Artificial Sequence
  derived and/or modified CDS sequence (AUadapt) from InfluenzaA__ACD85465__NA
augaaccccaaccagaagaucaucaccaucggcucggugucccugaccaucucgacgaucggguucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacucgauccgccuguccgccgggggcgacaucugggucacccgggagcccuacgugagcugcgaccccgacaagugcuaccaguucgcccucgggcagggcacgacccugaacaacgugcacuccaacgacaccguccgcgaccggaccccguaccgcacgcugcucaugaacgagcugggcgugcccuuccaccuggggaccaagcaggucugcaucgccuggucguccagcuccugccacgacggcaaggccuggcuccacgugugcaucaccggggacgacaagaacgcgaccgccucguucaucuacaacggccggcugguggacuccaucgugucgugguccaaggagauccugcgcacgcaggagagcgagugcgucugcaucaacgggaccugcaccguggugaugaccgacggcuccgccucgggcaaggccgacacgaagauccucuucaucgaggaggggaagaucguccacaccagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccucgucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcugcagaucaaccgccaggucaucguggaccgggggaaccgcagcggcuacuccgggaucuucucgguggagggcaagagcugcaucaaccggugcuucuacgucgagcucauccgcggccggaaggaggagaccgaggugcuguggaccuccaacucgaucguggucuucugcgggacguccggcaccuacgggaccggcagcuggccggacggggccgacaucaaccugaugcccaucuga

SEQ ID NO: 18817 - RNA, 1410 nt, Artificial Sequence
  derived and/or modified CDS sequence (AUadapt) from InfluenzaA__ACD85487__NA
augaaccccaaccagaagaucaucaccaucggcucggugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaacuccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18818 - RNA, 1410 nt, Artificial Sequence
  derived and/or modified CDS sequence (AUadapt) from InfluenzaA__ACD85498__NA
augaaccccaaccagaagaucaucaccaucggcucggugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18819 - RNA, 1410 nt, Artificial Sequence
  derived and/or modified CDS sequence (AUadapt) from InfluenzaA__ACD85509__NA
augaaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccgcaaccggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacgcaggagagcgagugcgucugcaucaacgggaccugcaccguggugaugaccgacggcuccgccucgggcaaggccgacacgaagauccucuucaucgaggagggcaagaucguccacaccagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggaggggucgcgcggcgugaaggggugggccuucgacgacggcaacgacgucuggauggggcggaccaucuccgagaagucccgccugggcuacgagaccuucaaggugaucgagggcuggagcaaccccaagucgaagcugcagaucaaccggcaggucaucguggaccgcgggaaccgguccggcuacagcgggaucuucucgguggagggcaaguccugcaucaaccgcugcuucuacgucgagcucauccgggggcgcaaggaggagaccgaggugcuguggaccagcaacuccaucguggucuucugcggcacgagcggcaccuacgggaccggcuccuggccggacggggccgacaucaaccugaugcccaucuga

SEQ ID NO: 18820 - RNA, 1410 nt, Artificial Sequence
  derived and/or modified CDS sequence (AUadapt) from InfluenzaA__ACD85520__NA
augaaccccaaccagaagaucaucaccaucggcucggugucccugaucaucucgaccaucggguucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggcuucgcgcccuucuccaaggacaacucgauccgccuguccgccgggggcgacaucugggucacccgggagcccuacgugagcugcgaccccgacaagugcuaccaguucgcccucgggcagggcaccacgcugaacaacgugcacuccaacgacaccguccgcgaccggaccccguaccgcacccugcucaugaacgagcugggcgugcccuuccaccuggggacgaagcaggucugcaucgccuggucguccagcuccugccacgacggcaaggccuggcuccacgugugcaucaccggggacgacaagaacgcgaccgccucguucaucuacaacggccggcugguggacuccaucgugagcugguccaaggagauccugcgcacccaggagucggagugcgucugcaucaacgggacgugcaccguggugaugaccgacggcuccgccagcggcaaggccgacaccaagauccucuucaucgaggaggggaagaucguccacacgucgacccuguccggcagcgcgcagcacguggaggagugcuccugcuacccccgguaccccggggugcgcugcgucugccgggacaacuggaagggcucgaaccgcccgaucguggacaucaacaucaaggaccacuccaucgugagcuccuacgucugcucgggccuggugggggacacgccccggaagaacgacuccagcuccucgucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcugcagaucaaccgccaggucaucguggaccgggggaaccgcagcggcuacuccgggaucuucucgguggagggcaagagcugcaucaaccggugcuucuacgucgagcucauccgcggccggaaggaggagaccgaggugcuguggaccuccaacucgaucguggucuucugcgggaccuccggcacguacgggaccggcagcuggccggacggggccgacaucaaccugaugcccaucuga

SEQ ID NO: 18821 - RNA, 1410 nt, Artificial Sequence; identical to SEQ ID NO: 18816
  derived and/or modified CDS sequence (AUadapt) from InfluenzaA__ACD85553__NA

SEQ ID NO: 18822 - RNA, 1410 nt, Artificial Sequence
  derived and/or modified CDS sequence (AUadapt) from InfluenzaA__ACD85564__NA
augaaccccaaccagaagaucaucaccaucggcucggugucccugaucaucucgaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaccgcccaccucaccaacacgaccaucgagaaggagaucugccccaagcuggcggaguaccggaacuggagcaagccgcagugcgacaucaccggguucgcccccuucuccaaggacaacucgauccgccuguccgccggcggggacaucugggugacccgggagcccuacgucagcugcgaccccgacaagugcuaccaguucgcccucggccaggggacgacccugaacaacgugcacuccaacgacaccgugcgcgaccggaccccguaccgcacgcugcucaugaacgagcugggcguccccuuccaccugggcaccaagcaggucugcaucgccuggucguccucguccugccacgacgggaaggcguggcuccacgugugcaucaccggcgacgacaagaacgccaccgccagcuucaucuacaacgggcggcugguggacuccaucgugucgugguccaaggagauccugcgcacgcaggagagcgagugcgugugcaucaacgggaccugcaccgucgugaugaccgacggguccgccucgggcaaggcggacacgaagauccucuucaucgaggagggcaagaucgugcacaccucgacccuguccgggagcgcccagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccucguccagcucccacugccucgaccccaacaacgaggagggcggccacggggugaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucgucgaccggggcaaccgcucgggguacuccggcaucuucucgguggagggcaagagcugcaucaaccggugcuucuacguggagcucauccgcgggcggaaggaggagaccgagguccuguggaccuccaacucgaucgugguguucugcggcacguccgggaccuacggcaccgggagcuggccggacggcgccgacaucaaccugaugcccaucuga

SEQ ID NO: 18823 - RNA, 1410 nt, Artificial Sequence
  derived and/or modified CDS sequence (AUadapt) from InfluenzaA__ACD85575__NA
augaaccccaaccagaagaucaucaccaucggcucggugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccacaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgacaucaaccugaugccgaucuga

SEQ ID NO: 18824 - RNA, 1410 nt, Artificial Sequence
  derived and/or modified CDS sequence (AUadapt) from InfluenzaA__ACD85586__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugucgugguccaaggagauccugcgcacgcaggagagcgagugcgucugcaucaacgggaccugcaccguggugaugaccgacggguccgccucgggcaaggccgacacgaagauccucuucaucgaggagggcaagaucguccacaccagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccucgucccacugccucgaccccaacaacgaggagggcggccgcggggugaagggcugggccuucgacgacgggaacgacgucuggaugggccggaccaucagcgagaagucccgccugggcuacgagaccuucaaggugaucgagggguggucgaaccccaaguccaagcugcagaccaaccggcaggucaucguggaccgcggcaaccggagcggguacuccggcaucuucucgguggagggcaagagcugcaucaaccgcugcuucuacgucgagcucauccgggggcgcaaggaggagaccgaggugcuguggacguccaacucgaucguggucuucugcggcaccuccgggaccuacggcaccgggagcuggccggacggcgccgacaucaaccugaugcccaucuga

SEQ ID NO: 18825 - RNA, 1410 nt, Artificial Sequence
  derived and/or modified CDS sequence (AUadapt) from InfluenzaA__ACD93582__NA
augaaccccaaccagaagaucaucaccaucggcucggugucccugaccaucucgacgaucugcuucuucaugcagaucgccauccucgccaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggucguccagcuccugccacgacggcaaggcguggcuccacgugugcaucaccggggacgacaagaacgccaccgccucguucaucuacaacggccggcugguggacuccaucgugagcugguccaaggagauccugcgcacccaggagucggagugcgucugcaucaacgggacgugcaccguggugaugaccgacggcuccgccagcggcaaggcggacaccaagauccucuucaucgaggaggggaagaucguccacacgucgacccuguccggcagcgcccagcacguggaggagugcuccugcuacccccgguaccccggggugcgcugcgucugccgggacaacuggaagggcucgaaccgcccgaucguggacaucaacaucaaggaccacuccaucgugagcuccuacgucugcucgggccuggugggggacacgccccggaagaacgacuccagcuccucgucccacugccucgaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcugcagaucaaccgccaggucaucguggacaaggggaaccggagcggcuacuccgggaucuucucgguggagggcaagagcugcaucaaccgcugcuucuacgucgagcucauccggggccgcaaggaggagaccgaggugcuguggaccuccaacucgaucguggucuucugcgggaccuccggcacguacgggaccggcagcuggccggacggggccgacaucaaccugaugcccaucuga

SEQ ID NO: 18826 - RNA, 1410 nt, Artificial Sequence; identical to SEQ ID NO: 17114
  derived and/or modified CDS sequence (AUadapt) from InfluenzaA__ACF09403__NA

SEQ ID NO: 18827 - RNA, 1410 nt, Artificial Sequence; identical to SEQ ID NO: 18331
  derived and/or modified CDS sequence (AUadapt) from InfluenzaA__ACF22151__NA

SEQ ID NO: 18828 - RNA, 1410 nt, Artificial Sequence; identical to SEQ ID NO: 16337
  derived and/or modified CDS sequence (AUadapt) from InfluenzaA__ACF22246__NA

SEQ ID NO: 18829 - RNA, 1410 nt, Artificial Sequence; identical to SEQ ID NO: 16337
  derived and/or modified CDS sequence (AUadapt) from InfluenzaA__ACF22257__NA

SEQ ID NO: 18830 - RNA, 1410 nt, Artificial Sequence; identical to SEQ ID NO: 16337
  derived and/or modified CDS sequence (AUadapt) from InfluenzaA__ACF22279__NA

SEQ ID NO: 18831 - RNA, 1410 nt, Artificial Sequence; identical to SEQ ID NO: 16337
  derived and/or modified CDS sequence (AUadapt) from InfluenzaA__ACF22290__NA

SEQ ID NO: 18832 - RNA, 1410 nt, Artificial Sequence; identical to SEQ ID NO: 16337
  derived and/or modified CDS sequence (AUadapt) from InfluenzaA__ACF22301__NA

SEQ ID NO: 18833 - RNA, 1410 nt, Artificial Sequence; identical to SEQ ID NO: 16337
  derived and/or modified CDS sequence (AUadapt) from InfluenzaA__ACF22312__NA

SEQ ID NO: 18834 - RNA, 1410 nt, Artificial Sequence
  derived and/or modified CDS sequence (AUadapt) from InfluenzaA__ACF22323__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccuacgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 18835 - RNA, 1410 nt, Artificial Sequence; identical to SEQ ID NO: 16337
  derived and/or modified CDS sequence (AUadapt) from InfluenzaA__ACF22334__NA

SEQ ID NO: 18836 - RNA, 1410 nt, Artificial Sequence; identical to SEQ ID NO: 16337
  derived and/or modified CDS sequence (AUadapt) from InfluenzaA__ACF22367__NA

SEQ ID NO: 18837 - RNA, 1410 nt, Artificial Sequence
  derived and/or modified CDS sequence (AUadapt) from InfluenzaA__ACF22378__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugcaagaaccccaacaacgagcgggggaaccagggcgugaaggggugggccuucgacaacggcgacgacgucuggaugggccgcaccaucagcaaggaccugcgguccggguacgagaccuucaaggugaucggcggguggucgacccccaacuccaagagccagaucaaccgccaggucaucguggacuccgacaaccggucgggcuacuccgggaucuucucgguggagggcaagagcugcaucaaccgcugcuucuacgucgagcucauccgcggccggaagcaggagacccgcgugugguggaccuccaacucgaucguggucuucugcgggaccuccggcacguacgggaccggcagcuggccggacggggccaacaucaacuucaugcccaucuga

SEQ ID NO: 18838 - RNA, 1410 nt, Artificial Sequence
  derived and/or modified CDS sequence (AUadapt) from InfluenzaA__ACF22389__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgugcccuucuccaaggacaacucgauccgccuguccgccggcggggacaucugggugacgcgggagcccuacgucagcugcgaccacggcaagugcuaccaguucgcccuggggcagggcaccacccucgacaacaagcacuccaacgacaccauccacgaccgcaucccccaccggacgcugcugaugaacgagcucggcgugccguuccaccuggggacccgccaggugugcaucgccuggucguccagcuccugccacgacggcaaggccuggcugcacgucugcaucaccggggacgacaagaacgcgaccgccucguucaucuacgacggccggcucguggacuccaucgggucguggucccagaacauccugcgcacgcaggagagcgagugcgugugcaucaacgggaccugcaccgucgugaugaccgacggcuccgccucgggccgggccgacacgcgcauccuguucaucgaggagggcaagaucgugcacaucagcccccucuccgggucggcgcagcacgucgaggagugcuccugcuacccccgguaccccggcgugcgcugcaucugccgggacaacuggaagggcagcaaccgcccgguggucgacaucaacauggaggacuacuccaucgacucguccuacgugugcagcgggcuggugggcgacacgccccggaacgacgaccgcuccucgaacuccaacugccggaaccccaacaacgagcgcgggaaccagggcgucaaggggugggccuucgacaacggcgacgacguguggaugggccggaccaucucgaaggaccugcgcuccggguacgagaccuucaaggucaucggcggguggagcacccccaacuccaagucgcagaucaaccgccaggugaucguggacuccgacaaccggagcggcuacuccgggaucuucucggucgagggcaagagcugcaucaaccgcugcuucuacguggagcucauccggggccgcaagcaggagacccgggugugguggaccuccaacucgaucgucguguucugcgggaccuccggcacguacgggaccggcagcuggccggacggggccaacaucaacuucaugcccaucuga

SEQ ID NO: 18839 - RNA, 1410 nt, Artificial Sequence
  derived and/or modified CDS sequence (AUadapt) from InfluenzaA__ACF22400__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucauggacuccaucgggucguggucccagaacauccugcgcacgcaggagagcgagugcgucugcaucaacgggaccugcaccguggugaugaccgacggcuccgccucgggccgggcggacacgcgcauccuguucaucgaggagggcaagaucguccacaucucgccccucuccgggagcgcccagcacguggaggagugcuccugcuacccccgguaccccggcgugcgcugcaucugccgggacaacuggaagggcucgaaccgcccggucguggacaucaacauggaggacuacuccaucgacagcuccuacgugugcucggggcuggucggcgacacgccccggaacgacgaccgcuccucgaacuccaacugccggaaccccaacaacgagcgcgggaaccagggcgugaaggggugggccuucgacaacggcgacgacguguggaugggccggaccaucagcaaggaccugcgcuccggguacgagaccuucaaggucaucggcggguggucgacccccaacuccaagagccagaucaaccgccaggugaucgucgacuccgacaaccggucgggcuacuccgggaucuucucgguggagggcaagagcugcaucaaccgcugcuucuacguggagcucauccggggccgcaagcaggagacccgggucugguggaccuccaacucgaucgugguguucugcgggaccuccggcacguacgggaccggcagcuggccggacggggccaacaucaacuucaugcccaucuga

SEQ ID NO: 18840 - RNA, 1410 nt, Artificial Sequence; identical to SEQ ID NO: 18468
  derived and/or modified CDS sequence (AUadapt) from InfluenzaA__ACF22411__NA

SEQ ID NO: 18841 - RNA, 1413 nt, Artificial Sequence
  derived and/or modified CDS sequence (AUadapt) from InfluenzaA__ACF33772__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacagcucccugugcucgaucuccggcugggccaucuacaccaaggacaacagcauccggaucggguccaagggcgacguguucgugauccgcgagcccuucaucucgugcucccaccucgagugcaagacguucuuccugacccagggggcccugcucaacgacaagcacagcaacggcaccgucaaggaccggucccccuaccgcgcccugaugagcugcccccugggggaggcgccgucccccuacaacucgaaguucgagagcguggccugguccgccagcgccugccacgacggcaucggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacggggccgccucguacaagaucuucaagaucgagaagggcaaggugaccaaguccauggagcucaacgccccgaacuucuacuacgaggagugcagcugcuaccccgacaccgggaccgucaugugcgugugccgcgacaacuggcacggcuccaaccggcccugggugagcuucaaccagaaccuggacuaccagaucggcuacaucugcuccggggucuucggcgacaacccccgcccgaaggacggggagggcucgugcaaccccgugacgguggacggggcgaacggcgucaagggcuucuccuacaaguacgggaacggcguguggaucgggcggaccaagagcaaccgcauccggaagggcuucgagaugaucugggaccccaacggguggaccaacaccgacuccgacuucucggugaagcaggacaucgucgccaucacggacugguccggcuacagcggcagcuucgugcagcaccccgagcugaccgggcucgacugcauccgcccgugcuucuggguggagcugguccggggccugccccgcgagaacaccaccaucuggacguccgggucguccaucagcuucugcggcgugaacuccgacaucgccaacuggagcuggcccgacggcgccgagcuccccuucaccaucgacaaguga

SEQ ID NO: 18842 - RNA, 1410 nt, Artificial Sequence
  derived and/or modified CDS sequence (AUadapt) from InfluenzaA__ACF33778__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcauccccuuccaccugggcacgaagcaggucugcaucgccugguccucguccagcugccacgacgggaaggccuggcuccacgugugcgugaccggcgacgacaagaacgcgaccgccuccuucaucuacaacgggcgccugguggacagcaucguguccuggucgaaggagauccugcggacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagaacguggaggagugcucgugcuacccccgcuaccccggcgugcggugcgucugccgcgacaacuggaagggguccaaccggccgaucguggacaucaacaucaaggacuacagcaucgugucccgcuacgucugcucgggccuggugggcgacacgccccggaagaacgacuccagcuccagcucccacugccucaaccccaacaacgaggagggcgggcacggggugaagggcugggccuucgacgacgggaacgacgucuggaugggccgcaccaucucggagaagucccggagcggcuacgagaccuucaaggugaucgaggggugguccaaccccaacucgaagcugcagaucaaccgccaggucaucguggaccggggcaaccgcuccggguacagcggcaucuucucgguggaggggaaguccugcaucaaccggugcuucuacgucgagcugauccgcggccggaaggaggagaccgaggugcucuggaccagcaacuccaucguggucuucugcggcaccagcgggacguacggcaccggguccuggccggacggcgccgacaucaaccugaugcccaucuga

SEQ ID NO: 18843 - RNA, 1410 nt, Artificial Sequence
  derived and/or modified CDS sequence (AUadapt) from InfluenzaA__ACF33785__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaugugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgugcgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccagcuucaucuacaacgggcgccuggucgacuccaucgugucgugguccaaggacauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucucggagaagcugcgccugggcuacgagaccuucaaggugaucgaggggugguccaaccccaacagcaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 18844 - RNA, 1413 nt, Artificial Sequence
  derived and/or modified CDS sequence (AUadapt) from InfluenzaA__ACF33787__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggccggcaacucgucccugugcagcaucuccggcugggccaucuacaccaaggacaacucgauccggaucggguccaagggcgacguguucgugauccgcgagcccuucaucagcugcucccaccucgagugcaagacguucuuccugacccagggggcccugcucaacgacaagcacagcaacggcaccgucaaggaccggucccccuaccgcgcccugaugucgugcccccugggggaggcgccgucccccuacaacagcaaguucgagucgguggccugguccgccagcgccugccacgacggcaucggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccgggaacggcgccgccuccuacaagaucuucaagaucgagaaggggaaggugaccaagucgauggagcucaacgccccgaacuuccacuacgaggagugcuccugcuaccccgacaccggcaccgucaugugcgugugccgcgacaacuggcacggcagcaaccggcccuggguguccuucaaccagaaccuggacuaccagaucggguacaucugcagcggcgucuucggggacaacccccgcccgaaggacggcgagggguccugcaaccccgugacgguggacggcgcgaacggcgucaagggguucucguacaaguacggcaacgggguguggaucggccggaccaaguccaaccgcauccggaagggguucgagaugaucugggaccccaacggcuggaccaacaccgacagcgacuucuccgugaagcaggacaucgucgccaucacggacuggucgggcuacuccgggagcuucgugcagcaccccgagcugaccggccucgacugcauccgcccgugcuucuggguggagcugguccgggggcugcccaaggagaacaccaccaucuggacgucgggcuccagcaucuccuucugcggcgugaacagcgggaucgccaacugguccuggcccgacggcgccgagcuccccuucaccaucgacaaguga

SEQ ID NO: 18845 - RNA, 1410 nt, Artificial Sequence; identical to SEQ ID NO: 18286
  derived and/or modified CDS sequence (AUadapt) from InfluenzaA__ACF33798__NA

SEQ ID NO: 18846 - RNA, 1410 nt, Artificial Sequence; identical to SEQ ID NO: 18459
  derived and/or modified CDS sequence (AUadapt) from InfluenzaA__ACF41672__NA

SEQ ID NO: 18847 - RNA, 1413 nt, Artificial Sequence; identical to SEQ ID NO: 18432
  derived and/or modified CDS sequence (AUadapt) from InfluenzaA__ACF41683__NA

SEQ ID NO: 18848 - RNA, 1410 nt, Artificial Sequence
  derived and/or modified CDS sequence (AUadapt) from InfluenzaA__ACF41749__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggggaucguguaccucaacaacaccaccaucgagaaggagaucugccccaagguggucgaguaccggaacuggagcaagccgcagugccagaucaccggcuucgcccccuucuccaaggacaacucgauccgccuguccgccgggggcgacaucugggugacgcgggagcccuacgugagcugcgaccacgggaagugcuaccaguucgcccugggccagggcaccacccucgacaacaagcacuccaacgacaccauccacgaccgcaucccccaccggacgcugcugaugaacgagcucggggucccguuccaccugggcacccgccaggugugcaucgccuggucguccucguccugccacgacgggaaggcguggcugcacgugugcaucaccggcgacgacaagaacgccaccgccagcuucaucuacgacgggcggcucgucgacuccaucggcucguggucccagaacauccugcgcacgcaggagagcgagugcgugugcaucaacgggaccugcaccguggucaugaccgacggcuccgccucgggccgggcggacacgcgcauccuguucaucgaggaggggaagaucgugcacaucucgccccucuccggcagcgcccagcacguggaggagugcuccugcuacccccgguaccccggcguccgcugcaucugccgggacaacuggaaggggucgaaccgcccggugguggacaucaacauggaggacuacuccaucgacagcuccuacgucugcucgggccuggugggggacacgccccggaacgacgaccgcuccucgaacuccaacugccggaaccccaacaacgagcgcggcaaccagggggugaagggcugggccuucgacaacggcgacgacgucuggauggggcggaccaucagcaaggaccugcgcuccggcuacgagaccuucaaggugaucgggggcuggucgacccccaacuccaagagccagaucaaccggcaggucaucguggacuccgacaaccgcucgggguacuccggcaucuucucgguggagggcaagagcugcaucaaccgcugcuucuacgucgagcucauccgggggcgcaagcaggagacccgggugugguggaccuccaacucgaucguggucuucugcggcaccuccgggacguacggcaccgggagcuggccggacggcgccaacaucaacuucaugcccaucuga

SEQ ID NO: 18849 - RNA, 1410 nt, Artificial Sequence
  derived and/or modified CDS sequence (AUadapt) from InfluenzaA__ACF41760__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccgcggcaagugcuaccaguucgcccuggggcagggcaccacccucgacaacaagcacuccaacgacaccauccacgaccggaucccccaccgcacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcggacgcaggagagcgagugcgugugcaucaacgggaccugcaccguggucaugaccgacggcuccgccucgggccgcgcggacacgcggauccuguucaucgaggagggcaagaucgugcacaucucgccccucuccgggagcgcccagcacguggaggagugcuccugcuacccccgcuaccccggcguccggugcaucugccgcgacaacuggaagggcucgaaccggccggugguggacaucaacauggaggacuacuccaucgacagcuccuacgucugcucggggcuggugggcgacacgccccgcaacgacgaccgguccucgaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggucgacccccaacuccaagagccagaucaaccgccaggucaucguggacuccgacaaccgcucgggcuacuccgggaucuucucgguggagggcaagagcugcaucaaccggugcuucuacgucgagcucauccgcggccggaagcaggagacccgcgugugguggaccuccaacucgaucguggucuucugcgggaccuccggcacguacgggaccggcagcuggccggacggggccaacaucaacuucaugcccaucuga

SEQ ID NO: 18850 - RNA, 1410 nt, Artificial Sequence
  derived and/or modified CDS sequence (AUadapt) from InfluenzaA__ACF41771__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaucaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 18851 - RNA, 1410 nt, Artificial Sequence; identical to SEQ ID NO: 16337
  derived and/or modified CDS sequence (AUadapt) from InfluenzaA__ACF41793__NA

SEQ ID NO: 18852 - RNA, 1410 nt, Artificial Sequence; identical to SEQ ID NO: 16337
  derived and/or modified CDS sequence (AUadapt) from InfluenzaA__ACF41804__NA

SEQ ID NO: 18853 - RNA, 1410 nt, Artificial Sequence; identical to SEQ ID NO: 16337
  derived and/or modified CDS sequence (AUadapt) from InfluenzaA__ACF41826__NA

SEQ ID NO: 18854 - RNA, 1365 nt, Artificial Sequence; identical to SEQ ID NO: 16322
  derived and/or modified CDS sequence (AUadapt) from InfluenzaA__ACF41837__NA

SEQ ID NO: 18855 - RNA, 1413 nt, Artificial Sequence
  derived and/or modified CDS sequence (AUadapt) from InfluenzaA__ACF41881__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcauccugcggacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgugaugugcgucugccgcgacaacuggcacgggagcaaccggcccuggguguccuucaaccagaaccuggacuaccagaucggcuacaucugcucgggcguguucggggacaacccccgccccaaggacggcgagggguccugcaacccggucacgguggacggcgcggacggggugaagggcuucagcuacaaguacggcaacggggucuggaucggccggaccaaguccaaccgccugcggaagggguucgagaugaucugggaccccaacggcuggaccgacaccgacagcgacuucuccgugaagcaggacguggucgccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 18856 - RNA, 1410 nt, Artificial Sequence; identical to SEQ ID NO: 18331
  derived and/or modified CDS sequence (AUadapt) from InfluenzaA__ACF41892__NA

SEQ ID NO: 18857 - RNA, 1410 nt, Artificial Sequence; identical to SEQ ID NO: 16729
  derived and/or modified CDS sequence (AUadapt) from InfluenzaA__ACF41903__NA

SEQ ID NO: 18858 - RNA, 1410 nt, Artificial Sequence
  derived and/or modified CDS sequence (AUadapt) from InfluenzaA__ACF41914__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccugggcguccggugcgugugccgcgacaacuggaaggggagcaaccggcccaucguggacaucaacaucaaggacuacuccaucgucagcuccuacgugugcucgggccucgugggcgacaccccgcgcaagaacgacuccagcuccucgucccacugccuggaccccaacaacgaggagggcgggcacggggucaagggcugggccuucgacgacgggaacgacguguggaugggccggaccaucagcgagaagcugcgcuccggcuacgagacguucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggcccgacggcgccgacaucaaccucaugccgaucuga

SEQ ID NO: 18859 - RNA, 1413 nt, Artificial Sequence
  derived and/or modified CDS sequence (AUadapt) from InfluenzaA__ACF41925__NA
augaaccccaaccagaagaucaucaccaucggcucgaucuccauggccaucgggaucaucucgcugauccuccagaucggcaacaucaucuccaucugggccagccacuccauccagaccgggucgcagaaccacacgggcaucugcaaccagcgcaucaucaccuacgagaacuccaccugggugaaccagaccuacgucaacaucaacaacacgaacgugguggcggggaaggacaagaccagcgucacccuggccggcaacuccucgcugugcccgauccggggcugggccaucuacaccaaggacaacuccauccgcaucgggagcaagggcgacguguucgugauccgggagcccuucaucuccugcucgcaccucgagugccgcacguucuuccugacccagggggcccugcucaacgacaagcacuccaacggcaccgucaaggaccggucgcccuaccgcgcccugauguccugcccccugggggaggcgccgagccccuacaacucccgguucgagucgguggccuggagcgccuccgccugccacgacggcaugggcuggcucaccaucgggaucucgggccccgacaacggggcgguggccguccugaaguacaacggcaucaucacggagaccaucaaguccuggaagaagcgcauccugcggacccaggagagcgagugcgugugcgugaacggcuccugcuucaccaucaugacggacgggcccucgaacggcgccgccuccuaccgcaucuucaagaucgagaaggggaaggucaccaagagcaucgagcucgacgccccgaacuaccacuacgaggagugcuccugcuaccccgacaccggcaccgugaugugcgugugccgggacaacuggcacgggucgaaccgccccugggucuccuucaaccagaaccuggacuaccagaucggcuacaucugcucgggcguguucggggacaacccccggccgaaggacggcgagggguccugcaaccccgugacggucgacggcgcggacggggugaagggcuucagcuaccgcuacggcaacgggguguggaucggccggaccaaguccaaccgccugcggaagggguucgagaugaucugggaccccaacggcuggaccgacaccgacucggacuucuccgucaagcaggacgugguggccaugacggacuggagcggguacuccggcucguucguccagcaccccgagcucaccggccuggacugcaugcgcccgugcuucuggguggagcugauccgggggcgcccccgggagaacaccaccaucuggacgagcggcuccucgaucuccuucugcggggucaacagcgacaccgccaacugguccuggcccgacggcgccgagcuccccuucaccaucgacaaguga

SEQ ID NO: 18860 - RNA, 1413 nt, Artificial Sequence; identical to SEQ ID NO: 18859
  derived and/or modified CDS sequence (AUadapt) from InfluenzaA__ACF41936__NA

SEQ ID NO: 18861 - RNA, 1410 nt, Artificial Sequence
  derived and/or modified CDS sequence (AUadapt) from InfluenzaA__ACF54392__NA
augaaccccaaccagaagaucaucaccaucggcucggugucccugaccacggccaccgccugcuuccucacccagaucgcgauccuggucaccacggugacccugcacuucaagcagcacgagugcgacucgccggccuccaaccaggugaugcccugcgagcccaucaucaucgagcgcaacaucaccgagaucgucuaccucaacaacaccacgaucgagaaggagaucugccccaaggugguggaguaccggaacuggucgaagccgcagugccagaucaccggguucgcccccuucuccaaggacaacagcauccgccuguccgccggcggggacaucugggucacccgggagcccuacgugucgugcgacuccggcaagugcuaccaguucgcccuggggcagggcaccacgcucgacaacaagcacucgaacgacaccauccacgaccgcaucccccaccggacccugcugaugaacgagcucggcgugccguuccaccuggggacccgccaggucugcaucgcgugguccagcuccucgugccacgacggcaaggccuggcugcacgugugcaucacgggggacgacaagaacgccaccgccuccuucaucuacgacggccggcucguggacucgaucggguccuggagccagaacauccugcgcacccaggaguccgagugcgucugcaucaacgggaccugcacgguggugaugaccgacggcucggcgucgggccgggccgacacccgcauccuguucaucgaggagggcaagaucguccacaucagcccccucuccggguccgcccagcacguggaggagugcucgugcuacccccgguaccccggcgugcgcugcaucugccgggacaacuggaagggcuccaaccgcccggucguggacaucaacauggaggacuacucgaucgacuccagcuacgugugcuccgggcuggucggcgacacgccccggaacgacgaccgcuucucgaacuccaacugccggaaccccaacaacgagcgcgggaaccagggcgugaaggggugggccuucgacaacggcgacgacguguggaugggccggaccaucucgaaggaccugcgcuccggguacgagaccuucaaggucaucggcggguggagcacccccaacuccaagucgcagaucaaccgccaggugaucgucgacuccgacaaccggucgggcuacuccgggaucuucagcguggagggcaagucgugcaucaaccgcugcuucuacguggagcucauccggggccgcaagcaggagacccgggucugguggacguccaacucgaucgugguguucugcgggaccuccggcaccuacgggaccggcagcuggccggacggggccaacaucaacuucaugcccaucuga

SEQ ID NO: 18862 - RNA, 1410 nt, Artificial Sequence; identical to SEQ ID NO: 16337
  derived and/or modified CDS sequence (AUadapt) from InfluenzaA__ACF54403__NA

SEQ ID NO: 18863 - RNA, 1410 nt, Artificial Sequence; identical to SEQ ID NO: 16337
  derived and/or modified CDS sequence (AUadapt) from InfluenzaA__ACF54414__NA

SEQ ID NO: 18864 - RNA, 1410 nt, Artificial Sequence; identical to SEQ ID NO: 16337
  derived and/or modified CDS sequence (AUadapt) from InfluenzaA__ACF54425__NA

SEQ ID NO: 18865 - RNA, 1410 nt, Artificial Sequence; identical to SEQ ID NO: 16337
  derived and/or modified CDS sequence (AUadapt) from InfluenzaA__ACF54436__NA

SEQ ID NO: 18866 - RNA, 1410 nt, Artificial Sequence
  derived and/or modified CDS sequence (AUadapt) from InfluenzaA__ACF54447__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggaccaagcaggucugcaucgccuggucguccucguccugccacgacggcaaggcguggcugcacgugugcaucaccggggacgacaagaacgccaccgccagcuucaucuacgacggccgccucguggacuccaucgggucguggucccagaacauccugcggacgcaggagagcgagugcgugugcaucaacgggaccugcaccguggucaugaccgacggcuccgccucgggccgcgcggacacgcggauccuguucaucgaggagggcaagaucgugcacaucucgccccucuccgggagcgcccagcacguggaggagugcuccugcuacccccgcuaccccggcguccggugcaucugccgcgacaacuggaagggcucgaaccggccggugguggacaucaacauggaggacuacuccaucgacagcuccuacgucugcucggggcuggugggcgacacgccccgcaacgacgaccgguccucgaacuccaacugccgcaaccccaacaacgagcgggggaaccagggcgugaaggggugggccuucgacaacggcgacgacgucuggaugggccgcaccaucagcaaggaccugcgguccggguacgagaccuucaaggugaucggcggguggucgacccccaacuccaagagccagaucaaccgccaggucaucguggacuccgacaaccggucgggcuacuccgggaucuucucgguggagggcaagagcugcaucaaccgcugcuucuacgucgagcucauccgcggccggaagcaggagacccgcgugugguggaccuccaacucgaucguggucuucugcgggaccuccggcacguacgggaccggcagcuggccggacggggccaacaucaacuucaugcccaucuga

SEQ ID NO: 18867 - RNA, 1410 nt, Artificial Sequence
  derived and/or modified CDS sequence (AUadapt) from InfluenzaA__ACF54469__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcauggccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 18868 - RNA, 1410 nt, Artificial Sequence; identical to SEQ ID NO: 18162
  derived and/or modified CDS sequence (AUadapt) from InfluenzaA__ACF54480__NA

SEQ ID NO: 18869 - RNA, 1410 nt, Artificial Sequence
  derived and/or modified CDS sequence (AUadapt) from InfluenzaA__ACF54502__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugagcuuccaccugggcaccaagcaggucugcguggcgugguccucguccucgugccacgacgggaaggccuggcugcacgugugcgucaccggcgacgaccgcaacgccaccgccuccuucaucuacgacgggcggcucguggacagcaucggcuccuggucgcagaacauccugcgcacgcaggaguccgagugcgugugcaucaacgggaccugcaccgucgugaugaccgacggcucggcgagcggccgggccgacacgcgcauccuguucaucaaggaggggaagaucgugcacaucucgccccucuccggcuccgcccagcacaucgaggagugcagcugcuacccccgguaccccgacguccgcugcaucugccgggacaacuggaagggcuccaaccgcccggugaucgacaucaacauggaggacuacucgaucgacuccucguacgugugcuccgggcuggucggcgacacgccccggaacgacgacagcuccucgaacuccaacugccgcgaccccaacaacgagcgggggaaccccggcgugaaggggugggccuucgacaacggcgacgacguguggaugggccgcaccaucaacaaggacucgcgguccggguacgagaccuucaaggucaucggcggguggagcaccccgaacuccaagucgcaggugaaccgccaggucaucguggacaacaacaacugguccggcuacucggggaucuucagcguggagggcaaguccugcaucaaccggugcuucuacgucgagcugauccgcggccgcccccaggagacccgggugugguggaccucgaacuccaucguggucuucugcgggaccagcggcacguacgggaccggcuccuggcccgacggggccaacaucaacuucaugcccaucuga

SEQ ID NO: 18870 - RNA, 1410 nt, Artificial Sequence; identical to SEQ ID NO: 18869
  derived and/or modified CDS sequence (AUadapt) from InfluenzaA__ACF54513__NA

SEQ ID NO: 18871 - RNA, 1410 nt, Artificial Sequence
  derived and/or modified CDS sequence (AUadapt) from InfluenzaA__ACF54524__NA
augaaccccaaccagaagaucaucaccaucggcucggugucccugaccaucgccacggucugcuucuucaugcagaucgccauccucgcgaccaccgugacccugcacuucaagcagcacgagugcgacucgccggccuccaaccaggugaugcccugcgagcccaucaucaucgagcgcaacaucacggagaucgucuaccugaacaacaccaccaucgagaaggagaucugccccgaggugguggaguaccggaacuggagcaagccgcagugccagaucaccggguucgcccccuucuccaaggacaacucgauccgccucuccgccggcggggacaucugggucacgcgggagcccuacgugagcugcgaccccggcaagugcuaccaguucgcccuggggcagggcaccacccuggacaacaagcacuccaacggcaccauccacgaccgcaucccgcaccggacgcuccugaugaacgagcugggggugucguuccaccucggcaccaagcaggucugcguggcgugguccucguccagcugccacgacgggaaggccuggcugcacgugugcgucaccggcgacgaccgcaacgccaccgccuccuucaucuacgacgggcggcugguggacucgaucggcuccuggagccagaacauccuccgcacgcaggaguccgagugcgugugcaucaacgggaccugcaccgucgugaugaccgacggcucggcgucgggccgggccgacacgcgcauccuguucaucaaggaggggaagaucgugcacaucagcccccuguccggcuccgcccagcacaucgaggagugcucgugcuacccccgguaccccgacguccgcugcaucugccgggacaacuggaagggcuccaaccgcccggugaucgacaucaacauggaggacuacagcaucgacuccucguacgugugcuccgggcucgucggcgacacgccccggaacgacgacucguccagcaacuccaacugccgcgaccccaacaacgagcgggggaaccccggcgugaaggggugggccuucgacaacggcgacgacguguggaugggccgcaccaucaacaaggacucgcgguccggguacgagaccuucaaggucaucggcggguggagcaccccgaacuccaagucgcaggugaaccgccaggucaucguggacaacaacaacugguccggcuacucggggaucuucagcguggagggcaaguccugcaucaaccggugcuucuacgucgagcugauccgcggccgcccccaggagacccgggugugguggaccucgaacuccaucguggucuucugcgggaccagcggcacguacgggaccggcuccuggcccgacggggccaacaucaacuucaugcccaucuga

SEQ ID NO: 18872 - RNA, 1410 nt, Artificial Sequence
  derived and/or modified CDS sequence (AUadapt) from InfluenzaA__ACF54535__NA
augaaccccaaccagaagaucaucaccaucggcucggugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccaagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 18873 - RNA, 1410 nt, Artificial Sequence; identical to SEQ ID NO: 16686
  derived and/or modified CDS sequence (AUadapt) from InfluenzaA__ACF54557__NA

SEQ ID NO: 18874 - RNA, 1410 nt, Artificial Sequence; identical to SEQ ID NO: 18331
  derived and/or modified CDS sequence (AUadapt) from InfluenzaA__ACF54568__NA

SEQ ID NO: 18875 - RNA, 1410 nt, Artificial Sequence
  derived and/or modified CDS sequence (AUadapt) from InfluenzaA__ACF54579__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaucaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18876 - RNA, 1362 nt, Artificial Sequence
  derived and/or modified CDS sequence (AUadapt) from InfluenzaA__ACF54601__NA
augaaucccaaccagaagaucaucaccaucggcucgaucugcaugguggucgggaucaucucccugauccuccagaucggcaacaucaucagcaucuggaucucccacagcauccagaccgggaaccagaaucacacgggcaucugcaaccagggguccaucaccuacaaggugguggccggccaggacagcaccuccgucauccugaccggcaacagcucccugugcccgauccgcgggugggccauccauagcaaggacaacggcauccggaucggguccaagggcgacguguucgugauccgcgagcccuucaucagcugcucccaucucgagugccggacguucuuccugacccagggggcgcugcucaacgacaagcacagccgcggcaccuucaaggaccggucccccuaucgcgcccugaugagcugccccgucggcgaggccccgucccccuacaacagccgguucgaguccguggccuggagcgccagcgcgugccaugacgggaugggcuggcugaccaucgggaucuccggccccgacgacggcgccguggccguccucaaguacaacgggaucaucacggagaccaucaagagcuggcgcaagaacauccugcggacccaggaguccgagugcacgugugugaacggcucgugcuucaccaucaugaccgacgggcccuccgacggccuggccagcuacaagaucuucaagaucgagaaggggaaggugaccaaguccaucgagcucaaugcgccgaacagccacuacgaggagugcuccugcuaccccgacaccggcaaggucaugugcgugugucgcgacaacuggcacggcagcaaccggcccuggguguccuucgaccagaaccuggauuacaagaucggguacaucugcagcggcgucuucggggacaacccccgcccgaaggacggcacgggguccugcggccccgugagugccgacggcgccaacggggugaagggcuucuccuacaaguacgggaacggcgucuggaucgggcggaccaagagcgacuccagccgccauggcuucgagaugaucugggaccccaacggcuggaccgagaccgacucccgguucagcaugcgccaggacgugguggccaugacggaccggaguggguacuccggcagcuucguccagcaccccgagcugaccgggcucgacugcaugcgcccgugcuucuggguggagcugauccggggccugcccgaggagaacgccaucuggaccuccggcaguaucaucuccuucugcggggugaacagcgacaccgucgacugguccuggcccgacggcgcggagcuccccuucacgaucgacaaguga

SEQ ID NO: 18877 - RNA, 1350 nt, Artificial Sequence
  derived and/or modified CDS sequence (AUadapt) from InfluenzaA__ACG50700__NA
augaaucccaaccaaaagaucaucaccaucggcagcaucugcauggugaucgggaucgucucccugaugcuccagaucggcaacaugaucagcaucugggugucccacaguauccagaccgggaaccagcaccaggccgagccgaucuccaacacgaacuuccugaccgagaaggccguggcgagcgucacccuggccggcaacaguccccucugccccaucuccgggugggccgugcacuccaaggacaacagcauccgcaucggcuccaagggcgacguguuugucauccgggagcccuucaucagcugcucccaccuggagugccgcaccuucuuccugacgcagggggcccuccugaaugacaagcacagcaacggcaccgugaaggaccgguccccgcaccgcacccugaugaguugccccgugggggaggcccccucccccuacaacagccgguucgaguccgucgcguggagcgccagcgccugucacgacggcaccuccuggcucacgaucgggaucagcggcccggacaacggcgccguggcggugcugaaguacaaugggaucaucaccgacaccaucaaguccuggcgcaacaacauccugcggacccaggagagcgagugcgccugcgucaacggcuccuguuucacggugaugaccgacgggcccagcaacggccaggccuccuacaagaucuucaagauggagaagggcaagguggucaagagcguggagcucgaugcccccaacuaccacuacgaggagugcuccugcuaucccgacgccagcgaggugaccugcgucugccgcgacaacuggcacggguccaaucggccgugggugagcuucaaccagaaccuggaguaccagaucggcuacaucuguuccgggguguucggcgacaacccccgccccaacgacgggaccggcagcugcggccccgucuccacgaauggggcguacggcgugaagggguucagcuucaaguacggcaacgggguguggaucggccggaccaaguccaccaauagccgcuccggcuucgagaugaucugggacagcaacggguggaccggcacggacagcuccuuuagcgucaagcaggacaucguggccaucaccgacugguccggguacagcggcuccuucguccagcauccggagcugaccgggcucgacugcauccggcccugcuucuggguggagcugauccgcggccggcccaaggagagcaccaucuggacguccggcagcuccaucagcuuuugcggggugaacuccgacaccgucggcuggagcuggcccgacggggccgagcugccguucaccaucgacaaguga

SEQ ID NO: 18878 - RNA, 1410 nt, Artificial Sequence; identical to SEQ ID NO: 18459
  derived and/or modified CDS sequence (AUadapt) from InfluenzaA__ACG70145__NA

SEQ ID NO: 18879 - RNA, 1410 nt, Artificial Sequence; identical to SEQ ID NO: 18286
  derived and/or modified CDS sequence (AUadapt) from InfluenzaA__ACG70156__NA

SEQ ID NO: 18880 - RNA, 1410 nt, Artificial Sequence
  derived and/or modified CDS sequence (AUadapt) from InfluenzaA__ACG80407__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccaaguaccggaacuggagcaagccgcagugcgacaucaccggguucgcgcccuucuccaaggacaacucgauccgccuguccgccggcggggacaucugggugacccgggagcccuacgucagcugcgaccccgacaagugcuaccaguucgcccucggccaggggaccacgcugaacaacgugcacuccaacgacaccgcccgcggccggaccccguaccgcacccugcucaugaacgagcugggcgugcccuuccaccuggggacgaagcaggucugcaucgccuggucguccagcuccugccacgacggcaaggcguggcuccacgugugcaucaccggggacgacaagaacgccaccgccucguucaucuacaacggccggcugguggacuccgucgugagcugguccaaggagauccugcgcacccaggagucggagugcgugugcaucaacgggacgugcaccgucgugaugaccgacggcuccgccagcggcgaggcggacaccaagauccucuucaucgaggaggggaagaucgugcacacgucgacccuguccggcagcgcccagcacgucgaggagugcuccugcuacccccgguaccccggggugcgcugcgugugccgggacaacuggaagggcucgaaccgcccgaucgucgacaucaacaucaaggaccacuccaucgugagcuccuacgugugcucgggccuggucggggacacgccccggaagaacgacuccagcuccucgucccacugccucgaccccaacaacgaggagggcgggcacggcgugaaggggugggccuucgacgacggcaacgacguguggaugggccgcaccaucagcgagaagucccggcugggguacgagaccuucaaggucaucgagggcuggucgaaccccaaguccaagcugcagaucaaccgccaggugaucgucgaccgggggaaccgcagcggcuacuccgggaucuucucgguggagggcaagagcugcaucaaccggugcuucuacguggagcucauccgcggccggaaggaggagaccgagguccuguggaccuccaacucgaucgugguguucugcgggaccuccggcacguacgggaccggcagcuggccggacggggccgacaucaaccugaugcccaucuga

SEQ ID NO: 18881 - RNA, 1410 nt, Artificial Sequence
  derived and/or modified CDS sequence (AUadapt) from InfluenzaA__ACG80411__NA
auggacucgaacuccaagaucaucaccaucggcagcgugucccugaccaucucgacgaucugcuucuucaugcagaucgccauccucaucaccaccgucacccugcacuucaagcaguacgaguucaacagcccgcccaacaaccagaugaugcugugcgagcccacgaucaucgagcgcaacaucaccgagaucguguaccucaccaacaccacgaucgagaaggagaucugccccaagcuggccgaguaccggaacuggucgaagccccagugcgacaucaccggguucgcgccguucuccaaggacaacagcauccgccuguccgccggcggggacaucugggugacccgggagcccuacgucucgugcgaccccgacaagugcuaccaguucgcccucggccaggggaccacgcugaacaacgugcacuccaacgacaccgccggcggccgcacccccuaccggacccugcucaugaacgagcugggggugccguuccaccugggcacgaagcaggucugcaucgccuggagcuccucguccugccacgacgggaaggcguggcuccacgugugcaucaccggcgacgacaagaacgccaccgccagcuucaucuacgacgggcgccugguggacggcgucguguccuggucgaaggagauccugcggacccaggaguccgagugcgugugcaucaacggcacgugcaccgucgugaugaccgacgggagcgccucgggcgaggcggacaccaagauccucuucaucgaggaggggaagaucgugcacacguccacccugagcggcuccgcccagcacgucgaggagugcucgugcuacccccgcuaccccggcgugcggugcgugugccgcgacaacuggaagggguccaaccggcccaucgucgacaucaacaucaaggaccacagcaucguguccucguacgugugcuccggccuggucggggacaccccgcgcaagaacgacagcuccucguccagccacugccucgaccccaacaacgaggagggcgggcacggcgugaagggcugggccuucgacgacgggaacgacguguggaugggccggaccaucuccgagaagucccgccugggguacgagacguucaaggucaucgagggcugguccaaccccaagucgaagcugcagaucaaccgccaggugaucgucgaccgggggaaccgguccggcuacagcggcaucuucucgguggaggggaaguccugcaucaaccgcugcuucuacguggagcucauccggggccgcaaggaggagaccgagguccuguggaccagcaacuccaucgugguguucugcgggaccagcggcacguacgggaccggcuccuggcccgacggcgccgacaucaaccugaugccgaucuga

SEQ ID NO: 18882 - RNA, 1407 nt, Artificial Sequence
  derived and/or modified CDS sequence (AUadapt) from InfluenzaA__ACG80421__NA
augaaccccauccagaagaucaucaccaucggcucggugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgucucgugcgaccccgacaagugcuaccaguucgcccucggccaggggaccacgcugaacaacgugcacuccgacaccgcccgcgaccggaccccguaccgcacccugcucaugaacgagcugggcgugcccuuccaccugggcacgaagcaggucugcaucgccuggagcuccucguccugccacgacgggaaggcguggcuccacgugugcaucaccggcgacgacaagaacgccaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcgaggcggacaccaagauccucuucaucgaggagggcaagaucgugcacacgagcacccuguccgggucggcccagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 18883 - RNA, 1407 nt, Artificial Sequence
  derived and/or modified CDS sequence (AUadapt) from InfluenzaA__ACG80427__NA
auggaccccaacucgaagaucaucaccaucggcuccgugagccugaccaucuccacgaucugcuucuucaugcagaucgccauccucaucaccaccgucacccugcacuucaagcaguacgaguucaacucgccgcccaacaaccagaugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggugacccgggagcccuacgucuccugcgaccccgacaagugcuaccaguucgcccucggccaggggaccacgcugaacaacgugcacagcgacaccgcccgcgaccggaccccguaccgcacccugcucaugaacgagcugggcgugcccuuccaccugggcacgaagcaggucugcaucgccugguccucguccagcugccacgacgggaaggcguggcuccacgugugcaucaccggcgacgacaagaacgccaccgccuccuucaucuacaacgggcggcugguggacucggucguguccuggagcaaggagauccugcgcacccaggaguccgagugcgugugcaucaacggcacgugcaccgucgugaugaccgacgggucggccagcggcgaggcggacaccaagauccucuucaucgaggagggcaagaucgugcacacguccacccugucgggguccgcccagcacgucgaggagugcagcugcuacccccgguaccccggcgugcgcugcgugugccgggacaacuggaagggguccaaccgcccgaucgucgacaucaacaucaaggaccacucgaucguguccagcuacgugugcuccggccuggucggcgacacgccccggaagaacgacucguccagcuccucgcacugccucgaccccaacaacgaggagggcgggcacggggugaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucgucgaccggggcaaccgcuccggguacagcggcaucuucucgguggaggggaaguccugcaucaaccggugcuucuacguggagcucauccgcggccggaaggaggagaccgagguccuguggaccagcaacuccaucgugguguucugcggcaccagcgggacguacggcaccggguccuggccggacggcgccgacaucaaccugaugcccaucuga

SEQ ID NO: 18884 - RNA, 1410 nt, Artificial Sequence
  derived and/or modified CDS sequence (AUadapt) from InfluenzaA__ACG80437__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccaacuucaucuacaacgggcggcugguggacuccaucgugagcugguccaaggagaucuuccgcacccaggagucggagugcgucugcaucaacggcacgugcaccguggugaugaccgacggguccgccagcggcaaggccgacaccaagauccuguucaucgaggagggcaagaucguccacacgucgacccucuccgggagcgcgcagcacguggaggagugcuccugcuacccccgguaccccggcgugcgcugcgucugccgggacaacuggaaggggucgaaccgccccaucguggacaucaacaucaaggaccacuccaucgugagcuccuacgucugcucgggccuggugggcgacaccccgcggaagaacgacuccagcuccagcucccacugccuggaccccaacaacgaggagggcgggcacggggugaagggcugggccuucgacgacgggaacgacgucuggaugggccgcaccaucucggagaagucccggagcggcuacgagacguucaaggugaucgaggggugguccaaccccaagucgaagcuccagaucaaccgccaggucaucguggaccggggcaaccgcuccggguacagcggcaucuucucgguggaggggaaguccugcaucaaccggugcuucuacgucgagcugauccgcggccggaaggaggagaccgaggugcuguggaccagcaacuccaucguggucuucugcggcaccagcgggacguacggcaccggguccuggcccgacggcgccgacaucaaccucaugccgaucuga

SEQ ID NO: 18885 - RNA, 1407 nt, Artificial Sequence
  derived and/or modified CDS sequence (AUadapt) from InfluenzaA__ACG80446__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggugacccgggagcccuacgucagcugcgaccccgacaagugcuaccaguucgcccucggccaggggaccacgcugaacaacgugcacuccgacaccgcccgcgaccggaccccguaccgcacccugcucaugaacgagcugggcgugcccuuccaccugggcacgaagcaggucugcaucgccuggucguccagcuccugccacgacgggaaggcguggcuccacgugugcaucaccggcgacgacaagaacgccaccgccucguucaucuacaacgggcggcugguggacuccgucgugagcugguccaaggagauccugcgcacccaggagucggagugcgugugcaucaacggcacgugcaccgucgugaugaccgacggguccgccagcggcgaggcggacaccaagauccucuucaucgaggagggcaagaucgugcacacgucgacccuguccgggagcgcccagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccucgucccacugccucgaccccaacaacgaggagggcgggcacggggugaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucgucgaccggggcaaccgcagcggguacuccggcaucuucucgguggagggcaagagcugcaucaaccggugcuucuacguggagcucauccgcgggcggaaggaggagaccgagguccuguggaccuccaacucgaucgugguguucugcggcaccuccgggacguacggcaccgggagcuggccggacggcgccgacaucaaccugaugcccaucuga

SEQ ID NO: 18886 - RNA, 1410 nt, Artificial Sequence
  derived and/or modified CDS sequence (AUadapt) from InfluenzaA__ACG80455__NA
augaaccccaaccagaagaucaucaccaucggcucgguguccuucaucaucagcuccaucugcuucuucaugcagaucgccauccugaucaccacggucacccuccacuucaagcaguacgaguucaacucgccgcccaacaaccagaugaugcugugcgagcccaccaucaucgagcgcaacaucaccgagaucguguaccugacgaacaccaccaucgagaaggagaucugccccaagcucgccgaguaccggaacugguccaagccgcagugcgacaucaccggguucgcgcccuucagcaaggacaacuccauccgccugagcgccggcggggacaucugggugacgcgggagcccuacgucuccugcgaccccgacaagugcuaccaguucgcccugggccaggggaccacccucaacaacgugcacucgaacgacaccgcccgcggccggacgccguaccgcacccugcugaugaacgagcucggcgugcccuuccaccuggggaccaagcaggucugcaucgccugguccagcuccucgugccacgacggcaaggcguggcugcacgugugcaucaccggggacgacaagaacgccacggccuccuucaucuacgacggccggcucguggacagcgucguguccuggagcaaggagauccugcgcacccaggaguccgagugcgugugcaucaacgggaccugcaccgucgugaugacggacggcucggccagcggcgaggcggacaccaagauccuguucaucgaggaggggaagaucgugcacaccuccacccucucgggcuccgcccagcacgucgaggagugcagcugcuacccccgguaccccggggugcgcugcgugugccgggacaacuggaagggcuccaaccgcccgaucgucgacaucaacaucaaggaccacagcaucguguccucguacgugugcuccggccuggucggggacacgccccggaagaacgacagcuccucguccagccacugccuggaccccaacaacgaggagggcgggcacggcgugaaggggugggccuucgacgacggcaacgacguguggaugggccgcaccaucuccgagaagucccggcucggguacgagaccuucaaggucaucgagggcuggagcaaccccaagucgaagcugcagaucaaccgccaggugaucgucgaccgggggaaccgcuccggcuacagcgggaucuucucgguggagggcaaguccugcaucaaccggugcuucuacguggagcugauccgcggccggaaggaggagaccgagguccucuggacgagcaacuccaucgugguguucugcgggaccagcggcaccuacgggaccggcuccuggccggacggggccgacaucaaccugaugcccaucuga

SEQ ID NO: 18887 - RNA, 1407 nt, Artificial Sequence; identical to SEQ ID NO: 18885
  derived and/or modified CDS sequence (AUadapt) from InfluenzaA__ACG80464__NA

SEQ ID NO: 18888 - RNA, 1410 nt, Artificial Sequence
  derived and/or modified CDS sequence (AUadapt) from InfluenzaA__ACG80473__NA
auggaccccauccagaagaucaucaccaucggcucggugucccugaccaucagcacgaucugcuucuucaugcagaucgccauccucaucaccaccgucacccugcacuucaagcaguacgaguucaacuccccgcccaacaaccagaugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacgacaccgcccgcggccggaccccguaccgcacccugcucaugaacgagcugggcgugcccuuccaccuggggacgaagcaggucugcaucgccuggagcuccucguccugccacgacggcaaggcguggcuccacgugugcaucaccggggacgacaagaacgccaccgccagcuucaucuacgacggccggcugguggacuccgucgugucgugguccaaggagauccugcgcacccaggagagcgagugcgugugcaucaacgggacgugcaccgucgugaugaccgacggcuccgccucgggcgaggcggacaccaagauccucuucaucgaggaggggaagaucgugcacacgagcacccuguccggcucggcccagcacgucgaggagugcuccugcuacccccgguaccccggggugcgcugcgugugccgggacaacuggaagggcagcaaccgcccgaucgucgacaucaacaucaaggaccacuccaucgugucguccuacgugugcagcggccuggucggggacacgccccggaagaacgacuccucguccagcucccacugccucgaccccaacaacgaggagggcgggcacggcgugaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucgucgaccgggggaaccgcucgggcuacuccgggaucuucagcguggagggcaagucgugcaucaaccggugcuucuacguggagcucauccgcggccggaaggaggagaccgagguccuguggaccuccaacagcaucgugguguucugcgggaccuccggcacguacgggaccggcagcuggccggacggggccgacaucaaccugaugcccaucuga

SEQ ID NO: 18889 - RNA, 1410 nt, Artificial Sequence; identical to SEQ ID NO: 17114
  derived and/or modified CDS sequence (AUadapt) from InfluenzaA__ACH69559__NA

SEQ ID NO: 18890 - RNA, 1410 nt, Artificial Sequence
  derived and/or modified CDS sequence (AUadapt) from InfluenzaA__ACH69570__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaacaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18891 - RNA, 1410 nt, Artificial Sequence; identical to SEQ ID NO: 17114
  derived and/or modified CDS sequence (AUadapt) from InfluenzaA__ACH69581__NA

SEQ ID NO: 18892 - RNA, 1410 nt, Artificial Sequence
  derived and/or modified CDS sequence (AUadapt) from InfluenzaA__ACH69592__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgucgccccugagcggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacucguccagcuccucgcacugccuggaccccaacaacgaggagggcgggcacggggucaagggcugggccuucgacgacggcaacgacguguggauggggcggaccaucuccgagaagucccgcucgggcuacgagaccuucaaggucaucgagggguggagcaagccgaacuccaagcugcagaucaaccgccaggugaucguggaccggggcaaccggucgggguacuccggcaucuucucggucgagggcaagagcugcaucaaccagugcuucuacguggagcucauccgcgggcggaagcaggagaccgaggugcuguggaccuccaacucgaucgucguguucugcggcaccuccgggaccuacggcacggggagcuggcccgacggcgccgaccugaaccucaugcccaucuga

SEQ ID NO: 18893 - RNA, 1410 nt, Artificial Sequence
  derived and/or modified CDS sequence (AUadapt) from InfluenzaA__ACH69603__NA
augaaccccaaccagaagaucaucaccaucggcucggugucccugaccaucgccacgaucugcuuccucaugcagaucgucauccuggugaccaccgugacccugcacuucaagcaguacgagugcaacucgccgcccaacaaccaggucaugcucugcgagcccacgaucaucgagcgcaacaucaccgagaucguguaccugaccaacaccacgaucgagaaggagaucugccccaagcuggccgaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgaagcaggucugcaucgccugguccucguccucgugccacgacggcaaggccuggcugcacgugugcgugaccggggacgacgagaacgcgaccgccuccuucaucuacaacggccgccuggucgacagcaucggguccuggucgaagaagauccuccggacccaggaguccgagugcgugugcaucaacggcacgugcaccguggucaugaccgacggcagcgccuccgggaaggccgacaccaagauccuguucaucgaggagggcaagaucgugcacacgucgccccugucgggguccgcgcagcacguggaggagugcagcugcuacccccgcuacccgggcguccggugcgugugccgcgacaacuggaagggcuccaaccggcccaucguggacaucaacgucaaggacuacucgaucguguccagcuacgugugcuccgggcucgucggcgacacgccccgcaagaacgacucguccucguccagccacugccuggaccccaacaacgaggagggcgggcacggggugaagggcugggccuucgacgacggcaacgacgucuggauggggcggaccaucuccgagaagucccgcucgggcuacgagaccuucaaggugaucgagggguggagcaagccgaacuccaagcugcagaucaaccgccaggugaucgucgaccggggcaaccggucgggguacuccggcaucuucucgguggagggcaagagcugcaucaaccgcugcuucuacguggagcucauccgggggcgcaagcaggagaccgagguccuguggaccuccaacucgaucgugguguucugcggcaccuccgggaccuacggcacggggagcuggcccgacggcgccgaccugaaccucaugcccaucuga

SEQ ID NO: 18894 - RNA, 1410 nt, Artificial Sequence
  derived and/or modified CDS sequence (AUadapt) from InfluenzaA__ACH69614__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgucgccccugagcggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacucguccagcuccucgcacugccuggaccccaacaacgaggagggcgggcacggggucaagggcugggccuucgacgacggcaacgacguguggauggggcggaccaucuccgagaagucccgcucgggcuacgagaccuucaaggucaucgagggguggagcaagccgaacuccaagcugcagaucaaccgccaggugaucguggaccggggcaaccggucgggguacuccggcaucuucucggucgagggcaagagcugcaucaaccgcugcuucuacguggagcucauccgggggcgcaagcaggagaccgaggugcuguggaccuccaacucgaucgucguguucugcggcaccuccgggaccuacggcacggggagcuggcccgacggcgccgaccugaaccucaugcccaucuga

SEQ ID NO: 18895 - RNA, 1413 nt, Artificial Sequence
  derived and/or modified CDS sequence (AUadapt) from InfluenzaA__ACI22525__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcgcauccugcggacccaggagucggagugcgugugcaugaacggcuccugcuucaccaucaugacggacggccccagcaacggggccgccuccuacaagaucuucaagaucgagaagggcaaggugaccaagucgaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggguacaucugcucgggcgucuucggcgacaacccccgccccaaggacggggagggcuccugcaacccggugacgguggacggggcggacggcgucaagggguucagcuacaaguacggcaacggcguguggaucgggcggaccaaguccaaccgccugcggaagggcuucgagaugaucugggaccccaacggguggaccaacaccgacagcgacuucuccgugaagcaggacgucguggccaucacggacuggucgggcuacagcggguccuucgugcagcaccccgagcucaccggccuggacugcauccgccccugcuucugggucgagcuggugcggggccucccgcgcgagaacaccaccaucuggacgucgggguccagcaucuccuucugcggcgucaacagcgacaccgccaacugguccuggcccgacggggccgagcugcccuucaccaucgacaaguga

SEQ ID NO: 18896 - RNA, 1413 nt, Artificial Sequence; identical to SEQ ID NO: 18895
  derived and/or modified CDS sequence (AUadapt) from InfluenzaA__ACI22526__NA

SEQ ID NO: 18897 - RNA, 1413 nt, Artificial Sequence; identical to SEQ ID NO: 18895
  derived and/or modified CDS sequence (AUadapt) from InfluenzaA__ACI22527__NA

SEQ ID NO: 18898 - RNA, 1413 nt, Artificial Sequence; identical to SEQ ID NO: 18895
  derived and/or modified CDS sequence (AUadapt) from InfluenzaA__ACI22528__NA

SEQ ID NO: 18899 - RNA, 1413 nt, Artificial Sequence; identical to SEQ ID NO: 18895
  derived and/or modified CDS sequence (AUadapt) from InfluenzaA__ACI22529__NA

SEQ ID NO: 18900 - RNA, 1413 nt, Artificial Sequence; identical to SEQ ID NO: 18895
  derived and/or modified CDS sequence (AUadapt) from InfluenzaA__ACI22530__NA

SEQ ID NO: 18901 - RNA, 1413 nt, Artificial Sequence
  derived and/or modified CDS sequence (AUadapt) from InfluenzaA__ACI22532__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcaugaacggcuccugcuucaccaucaugacggacgggcccagcaacggcgccgccuccuacaagaucuucaagaucgagaaggggaaggugaccaagucgaucgagcucaacgcccccaacuuccacuacgaggagugcuccugcuacccggacaccggcaccgucaugugcgugugccgcgacaacuggcacgggagcaaccggcccuggguguccuucaaccagaaccuggacuaccagaucggcuacaucugcucgggcgucuucggggacaacccccgccccaaggacggcgagggguccugcaacccggugacgguggacggcgcggacggggucaagggcuucagcuacaaguacggcaacgggguguggaucggccggaccaaguccaaccgccugcggaagggguucgagaugaucugggaccccaacggcuggaccaacaccgacagcgacuucuccgugaagcaggacgucguggccaucacggacuggucgggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 18902 - RNA, 1413 nt, Artificial Sequence; identical to SEQ ID NO: 18901
  derived and/or modified CDS sequence (AUadapt) from InfluenzaA__ACI22533__NA

SEQ ID NO: 18903 - RNA, 1413 nt, Artificial Sequence; identical to SEQ ID NO: 18895
  derived and/or modified CDS sequence (AUadapt) from InfluenzaA__ACI22534__NA

SEQ ID NO: 18904 - RNA, 1410 nt, Artificial Sequence
  derived and/or modified CDS sequence (AUadapt) from InfluenzaA__ACI25727__NA
augaaccccaaccagaagaucaucaccaucggcucggugucccugaccaucgccacggucugcuuccucaugcagaucgccauccuggugaccaccgugacccugcacuucaagcagcacgagugcaacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcaucgccuggagcuccucguccugccacgacggcaaggcguggcugcacgugugcaucaccggggacgacaagaacgccaccgccucguucaucuacgacggccggcucgucgacuccaucgggagcuggucccagaacauccugcgcacgcaggagucggagugcgugugcaucaacgggaccugcaccguggucaugaccgacggcuccgccucgggccgggcggacacgcgcauccuguucaucaaggagggcaagaucgugcacaucagcccccucuccgggucggcccagcacguggaggagugcuccugcuacccccgguacccgggcguccgcugcaucugccgggacaacuggaagggcagcaaccgccccgugguggacaucaacauggaggacuacuccaucgacucguccuacgucugcucggggcuggugggcgacacgccccggaacgacgaccgcuccagcaacuccaacugccggaaccccaacaacgagcgcgggaaccagggcgugaaggggugggccuucgacaacggcgacgacgucuggaugggccggaccaucucgaaggaccugcgcuccggguacgagaccuucaaggugaucggcggguggucgaccccgaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggcccgacggggccaacaucaacuucaugcccaucuga

SEQ ID NO: 18905 - RNA, 1410 nt, Artificial Sequence
  derived and/or modified CDS sequence (AUadapt) from InfluenzaA__ACI25749__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcacaucuga

SEQ ID NO: 18906 - RNA, 1410 nt, Artificial Sequence; identical to SEQ ID NO: 18905
  derived and/or modified CDS sequence (AUadapt) from InfluenzaA__ACI25760__NA

SEQ ID NO: 18907 - RNA, 1410 nt, Artificial Sequence; identical to SEQ ID NO: 18905
  derived and/or modified CDS sequence (AUadapt) from InfluenzaA__ACI25771__NA

SEQ ID NO: 18908 - RNA, 1410 nt, Artificial Sequence; identical to SEQ ID NO: 16337
  derived and/or modified CDS sequence (AUadapt) from InfluenzaA__ACI25782__NA

SEQ ID NO: 18909 - RNA, 1410 nt, Artificial Sequence
  derived and/or modified CDS sequence (AUadapt) from InfluenzaA__ACI25793__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgugggcggggacaucugggugacgcgggagcccuacgucagcugcgaccacggcaagugcuaccaguucgcccuggggcagggcaccacccucgacaacaagcacuccaacgacaccauccacgaccgcaucccccaccggacgcugcugaugaacgagcucggcgugccguuccaccuggggacccgccaggugugcaucgccuggucguccagcuccugccacgacggcaaggccuggcugcacgucugcaucaccggggacgacaagaacgcgaccgccucguucaucuacgacggccggcucguggacuccaucgggucguggucccagaacauccugcgcacgcaggagagcgagugcgugugcaucaacgggaccugcaccgucgugaugaccgacggcuccgccucgggccgggccgacacgcgcauccuguucaucgaggagggcaagaucgugcacaucagcccccucuccgggucggcgcagcacgucgaggagugcuccugcuacccccgguaccccggcgugcgcugcaucugccgggacaacuggaagggcagcaaccgcccgguggucgacaucaacauggaggacuacuccaucgacucguccuacgugugcagcgggcuggugggcgacacgccccggaacgacgaccgcuccucgaacuccaacugccggaaccccaacaacgagcgcgggaaccagggcgucaaggggugggccuucgacaacggcgacgacguguggaugggccggaccaucucgaaggaccugcgcuccggguacgagaccuucaaggucaucggcggguggagcacccccaacuccaagucgcagaucaaccgccaggugaucguggacuccgacaaccggagcggcuacuccgggaucuucucggucgagggcaagagcugcaucaaccgcugcuucuacguggagcucauccggggccgcaagcaggagacccgggugugguggaccuccaacucgaucgucguguucugcgggaccuccggcacguacgggaccggcagcuggccggacggggccaacaucaacuucaugcccaucuga

SEQ ID NO: 18910 - RNA, 1410 nt, Artificial Sequence
  derived and/or modified CDS sequence (AUadapt) from InfluenzaA__ACI25804__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgaccaccgcucgggcuacuccgggaucuucucgguggagggcaagagcugcaucaaccgcugcuucuacgucgagcucauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 18911 - RNA, 1410 nt, Artificial Sequence; identical to SEQ ID NO: 18869
  derived and/or modified CDS sequence (AUadapt) from InfluenzaA__ACI26277__NA

SEQ ID NO: 18912 - RNA, 1410 nt, Artificial Sequence; identical to SEQ ID NO: 16729
  derived and/or modified CDS sequence (AUadapt) from InfluenzaA__ACI26299__NA

SEQ ID NO: 18913 - RNA, 1410 nt, Artificial Sequence
  derived and/or modified CDS sequence (AUadapt) from InfluenzaA__ACI26321__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaccgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 18914 - RNA, 1410 nt, Artificial Sequence
  derived and/or modified CDS sequence (AUadapt) from InfluenzaA__ACI26354__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 18915 - RNA, 1410 nt, Artificial Sequence
  derived and/or modified CDS sequence (AUadapt) from InfluenzaA__ACI26365__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccugaccggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggaggggguccacggcgugaaggggugggccuucgacgacggcaacgacgucuggauggggcgcaccaucuccgagaagucccggcugggcuacgagaccuucaaggugaucgagggcuggagcaaccccaagucgaagcugcagaucaaccgccaggugaucgucgaccgggggaaccgcuccggcuacagcgggaucuucuccguggagggcaagucgugcaucaaccggugcuucuacguggagcucauccgcgggcggaaggaggagaccgagguccuguggaccagcaacuccaucgugguguucugcggcacgagcggcaccuacgggaccggcuccuggccggacggggccgacaucaaccugaugcccaucuga

SEQ ID NO: 18916 - RNA, 1410 nt, Artificial Sequence; identical to SEQ ID NO: 18914
  derived and/or modified CDS sequence (AUadapt) from InfluenzaA__ACI26376__NA

SEQ ID NO: 18917 - RNA, 1410 nt, Artificial Sequence; identical to SEQ ID NO: 18806
  derived and/or modified CDS sequence (AUadapt) from InfluenzaA__ACI26387__NA

SEQ ID NO: 18918 - RNA, 1410 nt, Artificial Sequence; identical to SEQ ID NO: 18818
  derived and/or modified CDS sequence (AUadapt) from InfluenzaA__ACI26420__NA

SEQ ID NO: 18919 - RNA, 1410 nt, Artificial Sequence; identical to SEQ ID NO: 16729
  derived and/or modified CDS sequence (AUadapt) from InfluenzaA__ACI26431__NA

SEQ ID NO: 18920 - RNA, 1413 nt, Artificial Sequence
  derived and/or modified CDS sequence (AUadapt) from InfluenzaA__ACI26442__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugcaagacguucuuccugacccagggggcccugcucaacgacaagcacuccaacggcaccgucaaggaccggucgcccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagucggagugcgugugcaugaacggguccugcuucaccaucaugacggacggccccagcaacggggccgccuccuacaagaucuucaagaucgagaagggcaaggugaccaagucgaucgagcucaacgcccccaacuuccacuacgaggagugcuccugcuacccggacaccgggaccgucaugugcgugugccgcgacaacuggcacggcagcaaccggcccuggguguccuucaaccagaaccuggacuaccagaucggcuacaucugcucgggggucuucggcgacaacccccgccccaaggaccgggagggguccugcaacccggugacgaucgacggcgcggacggggugaagggcuucagcuacaaguacggcaacggggucuggaucggccgcaccaaguccaaccggcugcgcaagggguucgagaugaucugggaccccaacggcuggaccaacaccgacagcgacuucuccgugaagcaggacguggucgccaucacggacuggucgggguacagcggcuccuucgugcagcaccccgagcucaccggccuggacugcauccggcccugcuucuggguggagcugguccgcgggcucccgcgggagaacaccaccaucuggacgucgggcuccagcaucuccuucugcggggugaacagcgacaccgccaacugguccuggcccgacggcgccgagcugcccuucaccaucgacaaguga

SEQ ID NO: 18921 - RNA, 1413 nt, Artificial Sequence; identical to SEQ ID NO: 18920
  derived and/or modified CDS sequence (AUadapt) from InfluenzaA__ACI26453__NA

SEQ ID NO: 18922 - RNA, 1410 nt, Artificial Sequence
  derived and/or modified CDS sequence (AUadapt) from InfluenzaA__ACI26464__NA
augaaccccaaccagaagaucaucaccaucggcucggugucccugaccaucucgacgaucugcuucuucaugcagaucgccauccucaucgccaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggagcaagccgcagugcgacaucacgggguucgcccccuucuccaaggacaacucgauccgccuguccgccggcggggacaucugggucacccgggagcccuacgugagcugcgaccccgacaagugcuaccaguucgcccucggccaggggaccacccugaacaacgugcacuccaacgacacgguccgcgaccggaccccguaccgcacccugcucaugaacgagcugggcgugcccuuccaccugggcaccaagcaggucugcaucgccuggucguccagcuccugccacgacgggaaggcguggcuccacgugugcaucacgggcgacgacaagaacgccaccgccucguucaucuacaacgggcggcugguggacuccaucgugagcugguccaaggagauccugcgcacccaggagucggagugcgucugcaucaacgggaccugcacgguggugaugaccgacggguccgccagcggcaaggcggacaccaagauccucuucaucgaggagggcaagaucguccacaccucgacgcuguccgggagcgcccagcacguggaggagugcuccugcuacccccgguaccccggcgugcgcugcgucugccgggacaacuggaaggggucgaaccgcccgaucguggacaucaacaucaaggaccacuccaccgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 18923 - RNA, 1410 nt, Artificial Sequence; identical to SEQ ID NO: 18913
  derived and/or modified CDS sequence (AUadapt) from InfluenzaA__ACI26475__NA

SEQ ID NO: 18924 - RNA, 1410 nt, Artificial Sequence; identical to SEQ ID NO: 18914
  derived and/or modified CDS sequence (AUadapt) from InfluenzaA__ACI26486__NA

SEQ ID NO: 18925 - RNA, 1410 nt, Artificial Sequence; identical to SEQ ID NO: 18914
  derived and/or modified CDS sequence (AUadapt) from InfluenzaA__ACI26497__NA

SEQ ID NO: 18926 - RNA, 1410 nt, Artificial Sequence; identical to SEQ ID NO: 18914
  derived and/or modified CDS sequence (AUadapt) from InfluenzaA__ACI26508__NA

SEQ ID NO: 18927 - RNA, 1410 nt, Artificial Sequence
  derived and/or modified CDS sequence (AUadapt) from InfluenzaA__ACI26519__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 18928 - RNA, 1410 nt, Artificial Sequence; identical to SEQ ID NO: 18914
  derived and/or modified CDS sequence (AUadapt) from InfluenzaA__ACI26530__NA

SEQ ID NO: 18929 - RNA, 1410 nt, Artificial Sequence; identical to SEQ ID NO: 18914
  derived and/or modified CDS sequence (AUadapt) from InfluenzaA__ACI26541__NA

SEQ ID NO: 18930 - RNA, 1410 nt, Artificial Sequence
  derived and/or modified CDS sequence (AUadapt) from InfluenzaA__ACI26552__NA
augaaccccaaccagaagaucaucaccaucggcucggugucccugaccaucgccacgaugugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacaagaacgcgaccgccucguucaucuacgacggccggcuggucgacuccaucgggagcugguccaagaacauccugcgcacccaggagucggagugcgugugcaucaacggcacgugcaccguggucaugaccgacggcuccgccagcgagcgggccgacaccaagauccucuucaucgaggaggggaagaucgugcacaucucgccccuguccggcagcgcgcagcacguggaggagugcuccugcuacccgcgcuaccccgggguccggugcgugugccgcgacaacuggaagggcucgaaccggcccaucguggacaucaacgucaaggacuacuccaucgugagcuccuacgugugcucgggccuggucggggacacgccccgcaagaacgaccgguccagcuccucguacugccgcaacccgaacaacgagaagggcucccacggggugaagggcugggccuucgacgacgggaacgacgucuggaugggccggaccaucagcgaggagcuccgcuccggcuacgagaccuucaaggugaucgggggcuggucgacccccaacuccaagcugcagaucaaccgccaggugaucgucgacagcgggaaccgguccggcuacucggggaucuucagcguggagggcaaguccugcaucaaccggugcuucuacguggagcugauccgcggccgcgagcaggagacgcgggucugguggaccucgaacuccaucgugguguucugcgggaccagcggcaccuacgggacgggcuccuggcccgacggggccgacaucaaccucaugcccaucuga

SEQ ID NO: 18931 - RNA, 1410 nt, Artificial Sequence
  derived and/or modified CDS sequence (AUadapt) from InfluenzaA__ACI26574__NA
augaaccccaaccagaagaucaucaccaucggcucggugucccugacccucgccacgaucugcuuccugaugcagaucgccauccuggucaccaccgugacccuccacuucaagcaguacgagugcagcuccccgcccaacaaccaggugaugcccugcgagcccacgaucaucgagcgcaacaucaccgagaucgucuaccugaccaacaucaccaucgagaaggagaucugcccgaagcugguggaguaccggaacuggucgaagccccagugcaagaucacgggguucgcgcccuucuccaaggacaacagcauccgccucuccgccggcggggacaucugggugacccgggagcccuacgucucgugcgacccguccaagugcuaccaguucgcccugggccaggggaccacccugaacaaccgccacagcaacgacacggugcacgaccggacccccuaccgcacccuccugaugaacgagcugggcgugcccuuccaccucggcacccggcaggucugcauggccugguccucguccagcugccacgacgggaaggccuggcugcacgugugcgugacgggccacgacgagaacgcgaccgccuccuucaucuacgacgggcgccuggucgacucgaucggcuccuggagcaagaacauccuccggacccaggaguccgagugcgugugcaucaacgggaccugcacgguggucaugaccgacggcucggccagcgagcgcgccgacaccaagauccuguucaucgaggagggcaagaucgugcacaucucgccccuguccggguccgcgcagcacguggaggagugcagcugcuacccgcgguaccccggcguccgcugcgugugccgggacaacuggaagggguccaaccgccccaucguggacaucaacgucaaggacuacucgaucguguccagcuacgugugcuccggccucgucggcgacacgccccggaagaacgaccgcucguccagcuccuacugccggaacccgaacaacgagaaggggucgcacggcgugaaggggugggccuucgacgacggcaacgacgucuggauggggcgcaccaucggcgaggagcugcgguccggcuacgagaccuucaaggugaucgggggcuggagcacccccaacuccaagcugcagaucaaccgccaggugaucgucgacucggggaaccgguccggcuacagcgggaucuucucgguggagggcaaguccugcaucaaccgcugcuucuacguggagcucauccgcggccggaagcaggagacccgcgucugguggacgagcaacuccaucgugguguucugcgggaccagcggcaccuacgggaccggcuccuggcccgacggggccgacaucaaccugaugcccaucuga

SEQ ID NO: 18932 - RNA, 1410 nt, Artificial Sequence
  derived and/or modified CDS sequence (AUadapt) from InfluenzaA__ACI26585__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacucgaacgacaccgugcacgaccggacccccuaccgcacccugcucaugaacgagcugggcgugcccuuccaccuggggacgaagcaggucugcaucgccugguccagcuccucgugccacgacggcaaggccuggcuccacgugugcgugaccgggcacgacgagaacgcgaccgccuccuucaucuacgacggccggcuggucgacagcaucguguccuggucgaagaacgugcugcgcacccaggaguccgagugcgucugcaucaacgggacgugcaccguggugaugaccgacggcucggccuccgagcgggccgacaccaagauccucuucaucgaggagggcaagaucguccacaucagcccccugucgggguccgcgcagcacguggaggagugcucgugcuacccgcgcuaccccggcgugcggugcgucugccgcgacaacuggaagggguccaaccggcccaucguggacaucaacgugaaggacuacagcaucgucuccucguacgugugcuccggccuggucggcgacacgccccgcaagaacgacagcuccucguccucguacugccggaacccgaacaacgagaaggggucccacggcgugaaggggugggccuucgacgacggcaacgacguguggauggggcgcaccaucggcgaggagcuccggagcggcuacgagaccuucaaggucaucgggggcugguccacccccaacucgaagcugcagacgaaccgccaggugaucguggaccgggggaaccgcuccggcuacucggggaucuucuccgucgagggcaagagcugcaucaaccggugcuucuacguggagcugauccgcggccgcaagcaggagaccaaggugugguggaccucgaacuccaucgucguguucugcgggaccagcggcacguacgggaccggcuccuggcccgacggggccgacaucaaccucaugcccaucuga

SEQ ID NO: 18933 - RNA, 1413 nt, Artificial Sequence
  derived and/or modified CDS sequence (AUadapt) from InfluenzaA__ACI32764__NA
augaaccccaaccagaagaucaucaccaucggcucgaucuccauggccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18934 - RNA, 1413 nt, Artificial Sequence
  derived and/or modified CDS sequence (AUadapt) from InfluenzaA__ACI32765__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacaacaccugggugaaccacaccuacgucaacaucaacaacacgaacgugguggcgcggaaggacaagaccuccgucacccuggccgggaacucgucccugugcagcaucuccggcugggccaucuacaccaaggacaacucgauccgcaucggcuccaagggggacguguucgugauccgggagccguucaucagcugcucccaccucgagugccgcacguucuucaugacccagggcgcccugcugaacgacaagcacucgaacgggaccgucaaggaccggucccccuaccgcgcccucaugagcugcccccugggcgaggcgcccuccccguacaacucgaaguucgagagcguggccugguccgccagcgccugccacgacgggaugggcuggcugaccaucggcaucuccgggcccgacaacggcgcgguggccguccucaaguacaacgggaucaucacggagaccaucaagucguggaagaagcggauccugcgcacccaggaguccgagugcgugugcgugaacggcagcugcuucaccaucaugacggacggccccuccaacggggccgccucguacaagaucuucaagaucgagaagggcaaggucaccaaguccguggagcugaacgcccccaacuuccacuacgaggagugcagcugcuacccggacaccgggaccgugaugugcgucugccgggacaacuggcacggcuccaaccgccccugggugucguucaaccagaaccucgacuaccagaucggguacaucugcuccggcguguucggcgacaacccccggcccaaggacgggaagggcagcugcaacccggucacgguggacggggcggacggcgugaagggguucuccuacaaguacggcaacggcgucuggaucgggcgcaccaagucgaaccggcugcgcaagggcuucgagaugaucugggaccccaacggguggaccgacaccgacuccgacuucagcgugaagcaggacguggucgccaucacggacugguccggcuacucggggagcuucgugcagcaccccgagcugaccggccucgacugcauccggcccugcuucugggucgagcuggugcgcggccugccgcgggagaacaccaccaucuggacguccgggucguccaucagcuucugcggcguggacuccgacaccgccaacuggagcuggcccgacggggccgagcuccccuucaccaucgacaaguga

SEQ ID NO: 18935 - RNA, 1413 nt, Artificial Sequence; identical to SEQ ID NO: 16788
  derived and/or modified CDS sequence (AUadapt) from InfluenzaA__ACI32766__NA

SEQ ID NO: 18936 - RNA, 1413 nt, Artificial Sequence
  derived and/or modified CDS sequence (AUadapt) from InfluenzaA__ACI32767__NA
augaaccccaaccagaagaucaucaccaucggcucgaucuccaucgccaucgggaucaucagccugaugcuccagaucggcaacaucaucuccaucugggccucgcacuccacccagacggggagccagaaccacaccggcaucugcaaccagcgcaucaucaccuacgagaacuccaccugggugaaccacacguacgucaacaucaacaacaccaacgugguggcggggaaggacaagaccucggucacccuggccggcaacuccagccugugcuccaucucgggcugggccaucuacacgaaggacaacuccgugcggaucgggagcaagggcgacguguucgucauccgcgagccguucaucuccugcucgcaccucgagugccggaccuucuuccugacccagggggcccugcucaacgacaagcacuccaacggcaccgugaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcggucgccgugcugaaguacaacggcaucaucaccgagaccaucaaguccuggaagaagcgcauccugcggacccaggagagcgagugcgugugcgucaacggcuccugcuucacgaucaugaccgacgggcccucgaacggcgccgccuccuacaagaucuucaagaucgagaaggggaaggugaccaagagcaucgagcucaacgcccccaacuuccacuacgaggagugcuccugcuacccggacaccggcacggugaugugcgucugccgcgacaacuggcacgggucgaaccggcccuggguguccuucaaccagaaccuggacuaccagaucggcuacaucugcagcggcguguucggggacaacccccgccccaaggacggcaagggguccugcaacccggucaccguggacggcgcggacggggugaagggcuucucguacaaguacggcaacggggucuggaucggccggaccaaguccaaccgccugcggaagggguucgagaugaucugggaccccaacggcuggaccgacacggacagcgacuucuccgugaagcaggacguggucgccaucaccgacuggucgggguacagcggcuccuucgugcagcaccccgagcucaccggccuggacugcauccgccccugcuucugggucgagcuggugcgggggcucccgcgcgagaacaccacgaucuggaccucgggcuccagcaucuccuucugcgggguggacagcgacaccgccaacugguccuggcccgacggcgccgagcugcccuucaccaucgacaaguga

SEQ ID NO: 18937 - RNA, 1413 nt, Artificial Sequence
  derived and/or modified CDS sequence (AUadapt) from InfluenzaA__ACI32768__NA
augaaccccaaccagaagaucaucaccaucggcucgaucuccaucgccaucgggaucaucagccugaugucccagaucggcaacaucaucucgaucugggccucccacagcauccagaccgggucccagaaccacacgggcaucugcaaccagcgcaucaucaccuacgagaacucgaccugggugaaccacaccuacgucaacaucaacaacacgaacgugguggcggggaaggacaagaccuccgucacccucgccggcaacagcucccugugcucgaucuccggcugggccaucuacaccaaggacaacagcauccggaucggguccaagggcgacguguucgugauccgcgagccguucaucagcugcucccaccuggagugccggacguucuuccucacccagggggcccugcugaacgacaagcacucgaacggcaccgucaaggaccgcucccccuaccgggcccucaugagcugcccccugggggaggcgcccucgccguacaacuccaaguucgagagcguggccugguccgccucggccugccacgacggcaugggcuggcugaccaucgggaucuccggccccgacaacggggcgguggccguccucaaguacaacggcaucaucacggagaccaucaagagcuggaagaagcgcauccugcggacccaggaguccgagugcgugugcgugaacggcucgugcuucaccaucaugacggacgggcccuccaacggcgccgccagcuacaagaucuucaagaucgagaaggggaaggucaccaaguccaucgagcugaacgcccccaacuuccacuacgaggagugcagcugcuacccggacaccggcaccgugaugugcgugugccgcgacaacuggcacggguccaaccggcccugggucucguucaaccagaaccucgacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagucgaaccgccugcggaagggguucgagaugaucugggaccccaacggcuggaccgacaccgacuccgacuucagcgucaagcaggacgugguggccaucacggacuggucgggguacuccggcagcuucguccagcaccccgagcugaccggccucgacugcauccgccccugcuucuggguggagcugguccgggggcugccgcgcgagaacaccaccaucuggacguccggcucguccaucagcuucugcgggguggacuccgacaccgccaacuggagcuggcccgacggcgccgagcuccccuucaccaucgacaaguga

SEQ ID NO: 18938 - RNA, 1413 nt, Artificial Sequence
  derived and/or modified CDS sequence (AUadapt) from InfluenzaA__ACI32769__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaucagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggaccuucuuccugacgcagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucaccgagacgaucaaguccuggaagaagcgcauccugcggacccaggagagcgagugcgugugcgugaacggcuccugcuucaccaucaugaccgacgggcccucgaacggcgccgccuccuacaagaucuucaagaucgagaaggggaaggucaccaagagcaucgagcucaacgcccccaacuuccacuacgaggagugcuccugcuacccggacacgggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugaccgucgacggcgcggacggggugaagggcuucagcuacaaguacggcaacgggguguggaucggccggacgaaguccaaccgccugcggaagggguucgagaugaucugggaccccaacggcuggaccgacaccgacucggacuucuccgucaagcaggacgugguggccaucaccgacuggagcggguacagcggcuccuucguccagcaccccgagcucacgggccuggacugcauccgccccugcuucuggguggagcugguccgggggcucccgcgcgagaacaccaccaucuggaccucgggcuccagcaucuccuucugcgggguggacagcgacacggccaacugguccuggcccgacggcgccgagcugcccuucaccaucgacaaguga

SEQ ID NO: 18939 - RNA, 1413 nt, Artificial Sequence; identical to SEQ ID NO: 16788
  derived and/or modified CDS sequence (AUadapt) from InfluenzaA__ACI32770__NA

SEQ ID NO: 18940 - RNA, 1413 nt, Artificial Sequence
  derived and/or modified CDS sequence (AUadapt) from InfluenzaA__ACI32771__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacaagaacuccaccugggugaaccacaccuacgucaacaucaacaacacgaacgugguggcggggaagggcaagaccucggucacccuggccggcaacuccagccugugcuccaucagcgggugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacggcaugggguggcucaccaucggcaucagcgggcccgacaacggcgcgguggccguccugaaguacaacggcaucaucacggagaccaucaaguccuggaagaagcgcauccugcggacccaggagucggagugcgugugcgugaacggguccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggcuacaucugcucggggguguucggcgacaacccccgccccaaggacgggaagggcuccugcaacccggugacggucgacggggcggacggcgugaagggcuucagcuacaaguacgggaacggcguguggaucgggcggaccaaguccaaccgccugcggaagggcuucgagaugaucugggaccccaacggguggaccgacaccgacagcgacuucuccgucaagcaggacgugguggccaucacggacuggucgggcuacagcggcuccuucguccagcaccccgagcucaccgggcuggacugcauccgccccugcuucuggguggagcugguccggggccucccgcgcgagaacaccaccaucuggacgucgggguccagcaucuccuucugcggcguggacagcgacaccgccaacugguccuggcccgacggcgccgagcugcccuucaccaucgacaaguga

SEQ ID NO: 18941 - RNA, 1413 nt, Artificial Sequence; identical to SEQ ID NO: 16788
  derived and/or modified CDS sequence (AUadapt) from InfluenzaA__ACI32772__NA

SEQ ID NO: 18942 - RNA, 1413 nt, Artificial Sequence; identical to SEQ ID NO: 16788
  derived and/or modified CDS sequence (AUadapt) from InfluenzaA__ACI32773__NA

SEQ ID NO: 18943 - RNA, 1413 nt, Artificial Sequence; identical to SEQ ID NO: 16788
  derived and/or modified CDS sequence (AUadapt) from InfluenzaA__ACI32774__NA

SEQ ID NO: 18944 - RNA, 1413 nt, Artificial Sequence; identical to SEQ ID NO: 16788
  derived and/or modified CDS sequence (AUadapt) from InfluenzaA__ACI32775__NA

SEQ ID NO: 18945 - RNA, 1413 nt, Artificial Sequence
  derived and/or modified CDS sequence (AUadapt) from InfluenzaA__ACI32776__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacaagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucaccaucgacaaguga

SEQ ID NO: 18946 - RNA, 1413 nt, Artificial Sequence
  derived and/or modified CDS sequence (AUadapt) from InfluenzaA__ACI32777__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacaagaacuccaccugggugaaccacaccuacgucaacaucaacaacacgaacgugguggcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcgcauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcaagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcgggguggacagcgacaccgccaacugguccuggcccgacggcgccgagcugcccuucgccaucgacaaguga

SEQ ID NO: 18947 - RNA, 1413 nt, Artificial Sequence; identical to SEQ ID NO: 16788
  derived and/or modified CDS sequence (AUadapt) from InfluenzaA__ACI32778__NA

SEQ ID NO: 18948 - RNA, 1413 nt, Artificial Sequence; identical to SEQ ID NO: 16788
  derived and/or modified CDS sequence (AUadapt) from InfluenzaA__ACI32779__NA

SEQ ID NO: 18949 - RNA, 1413 nt, Artificial Sequence; identical to SEQ ID NO: 16788
  derived and/or modified CDS sequence (AUadapt) from InfluenzaA__ACI32780__NA

SEQ ID NO: 18950 - RNA, 1413 nt, Artificial Sequence; identical to SEQ ID NO: 16788
  derived and/or modified CDS sequence (AUadapt) from InfluenzaA__ACI32781__NA

SEQ ID NO: 18951 - RNA, 1413 nt, Artificial Sequence
  derived and/or modified CDS sequence (AUadapt) from InfluenzaA__ACI32782__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacggggccgccuccuacaagaucuucaagaucgagaagggcaaggccaccaagagcaucgagcucaacgcgcccaacuuccacuacgaggagugcuccugcuacccggacaccgggaccgugaugugcgucugccgggacaacuggcacggcucgaaccgccccuggguguccuucaaccagaaccuggacuaccagaucggcuacaucugcagcgggguguucggcgacaacccccggcccaaggaccgcaagggguccugcaacccggucacgguggacggcgccgacggggugaagggcuucucguacaaguacggcaacggggucuggaucggccggaccaaguccaaccgccugcggaagggguucgagaugaucugggaccccaacggcuggaccaacaccgacagcgacuucuccgugaagcaggacguggucgccaucacggacuggucgggguacagcggcuccuucgugcagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 18952 - RNA, 1413 nt, Artificial Sequence
  derived and/or modified CDS sequence (AUadapt) from InfluenzaA__ACI32783__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggucggccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgggacaacuggcacgggagcaaccgccccuggcuguccuucaaccagaaccuggacuaccagaucggcuacaucugcucgggcgucaucggggacaacccccggcccaaggacggcaagggguccugcaacccggugacgguggacggcgcggacggggucaagggcuucagcuacaaguacggcaacgggguguggaucggccgcaccaaguccaaccggcuccgcaagggguucgagaugaucugggaccccaacggcuggaccgacaccgacucggacuucuccgugaagcaggacgucguggccaucacggacuggagcggguacucgggcuccuucgugcagcaccccgagcugaccggccuggacugcauccggcccugcuucugggucgagcucgugcgcgggcugccgcgggagaacaccaccaucuggacgagcggcuccucgaucuccuucugcggggucgacggcgacaccgccaacuggagcuggcccgacggcgccgagcugcccuucaccaucgacaaguga

SEQ ID NO: 18953 - RNA, 1413 nt, Artificial Sequence
  derived and/or modified CDS sequence (AUadapt) from InfluenzaA__ACI32784__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccucggucacccuggccggcaacuccagccugugcuccaucucgggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacggggccgccuccuacaagaucuucaagaucgagaagggcaaggccaccaagagcaucgagcucaacgcgcccaacuuccacuacgaggagugcuccugcuacccggacaccgggaccgugaugugcgucugccgggacaacuggcacggcucgaaccgccccuggguguccuucaaccagaaccuggacuaccagaucggcuacaucugcagcgggguguucggcgacaacccccggcccaaggaccgcgagggguccugcaacccggucacgguggacggcgccgacggggugaagggcuucucguacaaguacggcaacggggucuggaucggccggaccaaguccaaccgccugcggaagggguucgagaugaucugggaccccaacggcuggaccaacaccgacagcgacuucuccgugaagcaggacguggucgccaucacggacuggucgggguacagcggcuccuucgugcagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 18954 - RNA, 1413 nt, Artificial Sequence
  derived and/or modified CDS sequence (AUadapt) from InfluenzaA__ACI32785__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaugugcaaccagcgcaucaucaccuacgagaacuccaccugggugaaccacaccuacgucaacaucaacaacacgaacgugguggcggagaaggacaagaccucggucacccuggccgggaacuccagccugugcuccaucagcggcugggccaucuacaccaaggacaacuccauccggaucggcucgaagggggacguguucgugauccgcgagccguucaucuccugcagccaccucgagugccggacguucuuccugacccagggcgcccugcucaacgacaagcacuccaacgggaccgucaaggaccgcucgcccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcgcauccugcggacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggguacaucugcucgggcguguucggcgacaacccccgccccaaggacgggaagggcuccugcaacccggugacggucgacggggcggacggcgugaagggguucagcuacaaguacggcaacggcguguggaucgggcggaccaaguccaaccgccugcggaagggcuucgagaugaucugggaccccaacgggugggccgacaccgacagcgacuucuccgucaagcaggacgugguggccaucaccgacuggucgggcuacagcggguccuucguccagcaccccgagcucacgggccugaacugcauccgccccugcuucuggguggagcugguccggggccucccgcgcgagaacaccaccaucuggaccucgggguccagcaucuccuucugcggcguggacagcgacacggccaacugguccuggcccgacggggccgagcugcccuucaccaucgacaaguga

SEQ ID NO: 18955 - RNA, 1413 nt, Artificial Sequence
  derived and/or modified CDS sequence (AUadapt) from InfluenzaA__ACI32787__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccucgccguacaacagccgcuucgaguccguggccuggucggccuccgccugccacgacgggaugggcuggcucaccaucggcaucagcgggcccgacaacggcgcgguggccguccugaaguacaacgggaucaucacggagaccaucaaguccuggaagaagcggauccugcgcacccaggagucggagugcgugugcaugaacggcuccugcuucaccaucaugacggacggccccagcaacggggccgccuccuacaagaucuucaagaucgagaagggcaaggugaccaagaccaucgagcucaacgcccccaacuuccacuacgaggagugcucgugcuacccggacaccgggacggucaugugcgugugccgggacaacuggcacggcuccaaccgccccugggugagcuucaaccagaaccuggacuaccagaucggguacaucugcuccggcgucuucggcgacaacccccggcccaaggacggggagggcucgugcaacccggugaccguggacggggcggacggcgucaagggguucuccuacaaguacggcaacggcguguggaucgggcgcaccaagagcaaccggcugcgcaagggcuucgagaugaucugggaccccaacggguggaccaacacggacuccgacuucucggugaagcaggacgucguggccaucaccgacugguccggcuacagcgggucguucgugcagcaccccgagcucaccggccuggacugcauccggcccugcuucugggucgagcuggugcgcggccucccgcgggagaacaccacgaucuggaccuccgggagcuccaucagcuucugcggcgucaacgggggcaccgccgacugguccuggcccgacggcgccgagcugcccuucaccaucgacaaguga

SEQ ID NO: 18956 - RNA, 1413 nt, Artificial Sequence
  derived and/or modified CDS sequence (AUadapt) from InfluenzaA__ACI32788__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacggggaccugcaaccagcgcaucaucaccuacgagaacaacaccugggugaaccacacgugcgucaacaucaacaacaccaacgugguggcgggcaaggacaagaccuccgucacccuggugggcaacucgucccugugcagcaucuccggcugggccaucuacacgaaggacaacucgauccggaucggguccaagggcgacguguucgucauccgcgagccguucaucagcugcucccaccucgagugccggaccuucuuccugacccagggggcccugcucaacgacaagcacucgaacggcaccgugaaggaccgcucccccuaccgggcccugaugagcugcccccugggggaggcccccuccccguacaacucgaaguucgagagcguggcgugguccgccucggccugccacgacggcaagggcuggcucacgaucgggaucuccggccccgacaacggggccgucgcggugcugaaguacaacggcaucaucaccgagaccaucaagagcuggaagaagcgcauccugcggacccaggaguccgagugcgugugcgucaacggcucgugcuucacgaucaugaccgacgggcccuccaacggcgccgccagcuacaagaucuucaagaucgagaaggggaaggugaccaaguccaucgagcucaacgcccccaacuuccacuacgaggagugcucgugcuacccggacaccggcacggugaugugcgucugccgcgacaacuggcacggguccaaccggcccugggugagcuucaaccagaaccuggacuaccagaucggcuacaucugcuccggcguguucggggacaacccccgccccaaggacggcaaggggucgugcaacccgaugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucucggucaagcaggacgugguggcgaucaccgacugguccggguacagcggcucguucguccagcaccccgagcucaccggccuggacugcauccgccccugcuucuggguggagcugguccgggggcucccgcgcgagaacaccacgaucuggaccuccggcagcuccaucucguucugcgggguggacuccgacaccgccaacuggagcuggcccgacggcgccgagcugcccuucaccaucgacaaguga

SEQ ID NO: 18957 - RNA, 1410 nt, Artificial Sequence
  derived and/or modified CDS sequence (AUadapt) from InfluenzaA__ACI32790__NA
augaaccccaaccagaagaucaucaccaucggcucggugucccugaccaucgccacgaucugcuuccucacccagaucgccauccuggucaccaccgugacgcugcacuucaagcaguacgagugcaacucgccgcccaacaaccaggugaugcucugcgagcccaccaucaucgagcgcaacaucaccgagaucgucuaccugaccaacacgaccaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggacgacccugaacaacggccacucgaacgacaccguccacgaccgcaccccguaccggacgcuccugaugaacgagcugggcgugcccuuccaccucgggaccaagcaggucugcaucgccugguccagcuccucgugccacgacggcaaggcguggcugcacgugugcgugaccggggacgacaagaacgccaccgccuccuucaucuacaacggccgccugguggacagcaucggguccuggucgaagaagauccuccggacgcaggaguccgagugcgucugcaucaacgggaccugcaccguggugaugaccgacggcucggccuccgggaaggcggacacgaagauccuguucaucgaggagggcaagaucguccacaccagccugcucucgggguccgcccagcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcuggugggcgacacgccccgcaagaacgacagcuccucguccucgcacugccuggaccccaacaacgaggagggcggccacggggucaagggcugggccuucgacgacggcaacgacguguggauggggcggaccaucuccgagaagcuccgcagcggcuacgagaccuucaaggucaucgaggggugguccaagcccaacucgaagcugcagaucaaccgccaggugaucguggaccggggcaaccgguccggguacucgggcaucuucuccgucgagggcaagagcugcaucaaccgcugcuucuacguggagcugauccgggggcgcaaccaggagaccgaggugcucuggaccucgaacuccaucgucguguucugcggcaccagcgggacguacggcaccggguccuggccggacggcgccgacaucaaccugaugcccaucuga

SEQ ID NO: 18958 - RNA, 1410 nt, Artificial Sequence; identical to SEQ ID NO: 16784
  derived and/or modified CDS sequence (AUadapt) from InfluenzaA__ACI32791__NA

SEQ ID NO: 18959 - RNA, 1410 nt, Artificial Sequence; identical to SEQ ID NO: 16784
  derived and/or modified CDS sequence (AUadapt) from InfluenzaA__ACI32793__NA

SEQ ID NO: 18960 - RNA, 1410 nt, Artificial Sequence; identical to SEQ ID NO: 16784
  derived and/or modified CDS sequence (AUadapt) from InfluenzaA__ACI32794__NA

SEQ ID NO: 18961 - RNA, 1410 nt, Artificial Sequence; identical to SEQ ID NO: 17114
  derived and/or modified CDS sequence (AUadapt) from InfluenzaA__ACI32795__NA

SEQ ID NO: 18962 - RNA, 1410 nt, Artificial Sequence
  derived and/or modified CDS sequence (AUadapt) from InfluenzaA__ACI32796__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcuccaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcagcugcuacccccgcuaccccggcguccggugcgugugccgcgacaacuggaagggguccaaccggccgaucguggacaucaacaucaaggacuacucgaucgucuccagcuacgugugcuccggccuggugggcgacacgccccgcaagaacgacucguccagcuccucgcacugccucgaccccaacaacgaggagggcgggcacggggucaagggcugggccuucgacgacgggaacgacguguggaugggccggaccaucuccgagaagucccgcagcggcuacgagaccuucaaggucaucgagggguggagcaaccccaacuccaagcugcagaucaaccgccaggugaucguggaccggggcaaccggucgggguacagcggcaucuucuccgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 18963 - RNA, 1410 nt, Artificial Sequence
  derived and/or modified CDS sequence (AUadapt) from InfluenzaA__ACI32797__NA
augaaccccaaccagaugaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcuccaucaccggguucgcgcccuucagcaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggagcaaggagauccugcggacccaggaguccgagugcgugugcaucaacggcacgugcaccguggucaugaccgacgggucggccagcggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccagcuccucgcacugccucgaccccaacaacgaggagggcgggcacggggucaagggcugggccuucgacgacgggaacgacguguggaugggccggaccaucuccgagaagucccgcagcggcuacgagaccuucaaggucaucgagggguggucgaaccccaacuccaagcugcagaucaaccgccaggugaucguggaccggggcaaccggagcggguacagcggcaucuucuccgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 18964 - RNA, 1410 nt, Artificial Sequence
  derived and/or modified CDS sequence (AUadapt) from InfluenzaA__ACI32798__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaacgagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18965 - RNA, 1410 nt, Artificial Sequence
  derived and/or modified CDS sequence (AUadapt) from InfluenzaA__ACI32799__NA
augaaccccaaccagcgcaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcggcugguggacuccgucgugagcugguccaaggacauccugcgcacccaggagucggagugcgugugcaucaacggcacgugcaccgucgugaugaccgacggguccgccagcggcaaggccaacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaagaacuacuccaucgugucguccuacgugugcagcggccuggucggcgacacgccccggaagaccgacuccucguccagcucccacugccucgaccccaacaacgaggagggcgggcacggggugaagggcugggccuucgacgacgggaacgacgucuggaugggccgcaccaucagcgagaagcugcggcugggcuacgagaccuucaaggugaucgaggggugguccaaccccaacucgaagcuccagaucaaccgccaggugaucgucgaccggggcaaccgcuccggguacagcggcaucuucuccguggagggcaagucgugcaucaaccggugcuucuacguggagcugauccgcgggcggaaggaggagaccgagguccuguggaccagcaacuccaucgugguguucugcggcacgagcgggaccuacggcaccggguccuggccggacggcgccgacaucaaccucaugcccaucuga

SEQ ID NO: 18966 - RNA, 1410 nt, Artificial Sequence
  derived and/or modified CDS sequence (AUadapt) from InfluenzaA__ACI32800__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaccaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcacguccgggaccuacggcaccgggagcuggccggacggcgccgacaucaaccugaugcccaucuga

SEQ ID NO: 18967 - RNA, 1410 nt, Artificial Sequence; identical to SEQ ID NO: 18966
  derived and/or modified CDS sequence (AUadapt) from InfluenzaA__ACI32802__NA

SEQ ID NO: 18968 - RNA, 1410 nt, Artificial Sequence; identical to SEQ ID NO: 18966
  derived and/or modified CDS sequence (AUadapt) from InfluenzaA__ACI32803__NA

SEQ ID NO: 18969 - RNA, 1410 nt, Artificial Sequence; identical to SEQ ID NO: 18109
  derived and/or modified CDS sequence (AUadapt) from InfluenzaA__ACI32804__NA

SEQ ID NO: 18970 - RNA, 1410 nt, Artificial Sequence
  derived and/or modified CDS sequence (AUadapt) from InfluenzaA__ACI32805__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgugaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggacuacuccaucgugucguccuacgugugcagcggccuggucggcgacacgccccgcaagaacgaccgguccucguccagccacugccucgaccccaacaacgaggagggcgggcacggggugaagggcugggccuucgacgacgggaacgacgucuggaugggccgcaccaucuccgagaagucccggucgggcuacgagaccuucaaggugaucgagggguggagcaaccccaacuccaagcugcagaccaaccgccaggugaucgucgaccggggcaaccgcucgggguacuccggcaucuucagcguggagggcaagucgugcaucaaccggugcuucuacguggagcugauccgcgggcggaaggaggagaccgagguccucuggaccuccaacagcaucgugguguucugcggcacguccgggaccuacggcaccgggagcuggccggacggcgccgacaucaaccugaugcccaucuga

SEQ ID NO: 18971 - RNA, 1410 nt, Artificial Sequence; identical to SEQ ID NO: 17114
  derived and/or modified CDS sequence (AUadapt) from InfluenzaA__ACI32806__NA

SEQ ID NO: 18972 - RNA, 1410 nt, Artificial Sequence
  derived and/or modified CDS sequence (AUadapt) from InfluenzaA__ACI32807__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 18973 - RNA, 1410 nt, Artificial Sequence
  derived and/or modified CDS sequence (AUadapt) from InfluenzaA__ACI32808__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccgucgugagcugguccaaggacauccugcggacccaggagucggagugcgugugcaucaacggcacgugcaccgucgugaugaccgacggguccgccagcggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaagaacuacuccaucgugucguccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggagaagaccgagguccuguggaccagcaacuccaucgugguguucugcggcacgagcgggaccuacggcaccggguccuggccggacggcgccgacaucaaccucaugcccaucuga

SEQ ID NO: 18974 - RNA, 1410 nt, Artificial Sequence; identical to SEQ ID NO: 18109
  derived and/or modified CDS sequence (AUadapt) from InfluenzaA__ACI32809__NA

SEQ ID NO: 18975 - RNA, 1410 nt, Artificial Sequence
  derived and/or modified CDS sequence (AUadapt) from InfluenzaA__ACI32810__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccgcaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccgucgugucgugguccaaggacauccugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggagcgcgcagcacgucgaggagugcuccugcuacccccgcuaccccggcgugcggugcgugugccgcgacaacuggaaggggucgaaccggccgaucgucgacaucaacaucaagaacuacuccaucgugagcuccuacgugugcucgggccuggucggcgacacgccccgcaagaccgacuccagcuccucgucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 18976 - RNA, 1410 nt, Artificial Sequence
  derived and/or modified CDS sequence (AUadapt) from InfluenzaA__ACI32811__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 18977 - RNA, 1410 nt, Artificial Sequence
  derived and/or modified CDS sequence (AUadapt) from InfluenzaA__ACI32812__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccgucgugagcugguccaaggacauccugcggacccaggagucggagugcgugugcaucaacggcacgugcaccgucgugaugaccgacggguccgccagcggcaaggccaacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaagaacuacuccaucgugucguccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 18978 - RNA, 1410 nt, Artificial Sequence; identical to SEQ ID NO: 17201
  derived and/or modified CDS sequence (AUadapt) from InfluenzaA__ACI32814__NA

SEQ ID NO: 18979 - RNA, 1350 nt, Artificial Sequence
  derived and/or modified CDS sequence (AUadapt) from InfluenzaA__ACJ53848__NA
augaaucccaaccaaaagaucaucaccaucggcagcaucugcauggugaucgggaucgucucccugaugcuccagaucggcaacaugaucagcaucugggugucccacagcauccagaccgggaaucagugccaggccgagccgaucuccaacacgaaguuccugaccgaaaaggccguggcgagcgucacccuggccggcaacuccagccucugccccaucuccgggugggccguguacaguaaggacaacuccauccgcaucggcagccggggcgacguguucgucauccgcgagcccuucaucuccugcagccaucuggagugccggaccuucuuccugacgcagggggcccuccugaacgacaagcacuccaacggcaccgugaaggaccgcaguccccaccggacccugauguccugcccggugggggaggcccccagccccuacaacucccgcuucgaaagcgucgcguggagcgccuccgccugucacgacggcaccagcuggcucacgaucgggaucuccggccccgacaacggcgccguggcggugcugaaguacaacgggaucaucaccgacaccaucaagaguuggcggaacaacauccugcgcacccaggaguccgagugcgccugcgucaacggcagcugcuucacggugaugaccgaugggccguccagcggccaggccuccuacaagaucuucaaaauggagaagggcaagguggucaagagcguggagcucgacgcccccaacuaccacuaugaggagugcuccugcuaccccgacgccggggagaucacgugcgugugccgggacaacuggcauggcagcaaccgccccugggucuccuucaaccaaaaccuggaguaccagaucggguacaucugcaguggcguguucggggacaacccgcggcccaacgacggcaccggcuccugcgggcccgugagccccaacggcgcguauggggucaagggcuucuccuucaaguacgggaacggcguguggaucggccgcaccaagagcaccaacucccggagcggguucgagaugaucugggauccgaacggcuggaccgggaccgacagcuccuucagcgugaagcaagacaucgucgccaucacggacugguccggcuacaguggguccuucgugcagcaccccgagcugaccggccucgacugcauccgccccugcuucugggucgagcugauccggggccgccccaaggagagcaccaucuggaccuccgggagcuccaucaguuucugcggcgugaacuccgacacggugagcugguccuggccggacggggccgagcugcccuucaccaucgacaaguga

SEQ ID NO: 18980 - RNA, 1350 nt, Artificial Sequence
  derived and/or modified CDS sequence (AUadapt) from InfluenzaA__ACJ53849__NA
augaaucccaaccaaaagaucaucaccaucggcagcaucugcauggugaucgggaucgucucccugaugcuccagaucggcaacaugaucagcaucugggugucccacagcauccagaccgggaaccagugucaggccgagccgaucuccaacacgaaguuccugaccgagaaggccguggcgagcgucacccuggccggcaacuccagccucugccccaucuccgggugggccguguacagcaaagauaacuccauccgcaucggcagccggggcgacguguucgucauccgcgagcccuucaucuccugcagccaccuggagugucggaccuucuuccugacgcagggggcccuccugaacgacaagcacuccaacggcaccgugaaggaccgcagcccccaucggacccugauguccugcccggugggggaggcccccagccccuacaacucccgcuucgagagcgucgcguggagcgccuccgccugccaugacggcaccagcuggcucacgaucgggaucuccggccccgacaacggcgccguggcggugcugaaguacaacgggaucaucaccgacaccaucaagagcuggcggaauaacauccugcgcacccaagaguccgagugcgccugcgucaacggcagcugcuucacggugaugaccgacgggccguccaguggccaggccuccuacaagaucuucaagauggagaagggcaagguggucaagagcguggaacucgacgcccccaacuaccacuacgaggaguguuccugcuaccccgacgccggggagaucacgugcgugugccgggacaacuggcacggcaguaaccgccccugggucuccuucaaccagaaccuggaguaccagaucggguacaucugcagcggcguguuuggggacaacccgcggcccaacgacggcaccggcuccugcagccccgugucccccaacggggcguacggcgucaagggguuuagcuucaaguacggcaacgggguguggaucggccgcaccaaguccaccaacagccggagcggcuucgaaaugaucugggauccgaacggguggaccggcaccgacuccagcuucuccgugaagcaggacaucgucgccaucacggacuggagcggguacuccggcaguuucgugcagcaccccgagcugaccgggcucgacugcauccgccccugcuucugggucgagcugauccggggccgccccaaggaguccaccaucuggaccagcggcuccagcaucuccuuuugcggggugaacagcgacacgguguccuggagcuggccggacggcgccgagcugcccuucaccaucgacaaguga

SEQ ID NO: 18981 - RNA, 1350 nt, Artificial Sequence; identical to SEQ ID NO: 16398
  derived and/or modified CDS sequence (AUadapt) from InfluenzaA__ACJ53853__NA

SEQ ID NO: 18982 - RNA, 1350 nt, Artificial Sequence; identical to SEQ ID NO: 16398
  derived and/or modified CDS sequence (AUadapt) from InfluenzaA__ACJ53866__NA

SEQ ID NO: 18983 - RNA, 1350 nt, Artificial Sequence
  derived and/or modified CDS sequence (AUadapt) from InfluenzaA__ACJ53867__NA
augaaucccaaccaaaagaucaucaccaucggcagcaucugcauggccaucgggaucgugucccugaugcuccagaucggcaacaugaucagccugugggucucccacagcauccagaccgggaaucagugccaggccgagccgaucuccaacacgaaauuccugaccgagaaggcgguggccagcgugacccucgccggcaacuccagccugugccccaucuccgggugggccgucuauagcaaggacaacuccauccgcaucggcagccggggcgacguguucgugauccgcgagcccuucaucuccugcagucaccuggagugccggaccuucuuccucacgcagggggcccugcugaacgacaaacacuccaauggcaccgucaaggaccgcagcccccaccggacccucauguccugcccggugggggaggcgcccagccccuacaacucccgcuuugagagcguggccuggagcgccuccgccugccacgacggcaccagcuggcugacgaucgggaucuccggccccgacaacggcgcggucgccgugcugaaguauaacgggaucaucaccgacaccaucaagagcuggcggaacaacauccuccgcacccaggaauccgagugcgccugcgugaauggcagcugcuucacggucaugaccgacgggccguccagcggccaggccuccuacaagaucuucaagauggagaagggcaagguggucaaaagcguggagcuggaugcccccaacuaccacuacgaggagugcuccugcuaccccgaugcgggggagaucacgugcgugugccgggacaacuggcacggcagcaaccgccccuggguguccuuuaaccagaaccuggaguaccaaaucggguacaucugcagcggcgucuucggggacaauccgcggcccaacgacggcaccggcuccugcgggcccgugagccccaacggcgccuacggggugaagggcuucuccuuuaaguacgggaacggcgucuggaucggccgcaccaagagcaccaacucccggagcggguucgagaugaucugggacccgaauggcuggaccgggaccgacagcuccuucagcgugaagcaggacaucguggccaucacggacugguccggcuacagcggguccuuuguccaacaccccgagcucaccggccuggacugcauccgccccugcuucuggguggagcugauccggggccgccccaaggagagcaccaucuggaccuccgggagcuccaucaguuucugcggcgucaacuccgacacggugagcugguccuggccggacggggccgagcuccccuucaccaucgacaaguga

SEQ ID NO: 18984 - RNA, 1350 nt, Artificial Sequence
  derived and/or modified CDS sequence (AUadapt) from InfluenzaA__ACJ53875__NA
augaaucccaaccaaaagaucaucaccaucggcagcaucugcauggugaucgggaucgucucccugaugcuccagaucggcaacaugaucagcaucugggugucccacagcauccagaccgggaaccagugucaggccgagccgaucuccaacacgaaguuccugaccgaaaaggccguggcgagcgucacccuggccggcaacuccagccucugccccaucuccgggugggccguguacagcaaggacaauuccauccgcaucggcagccggggcgacguguucgucauccgcgagcccuucaucuccugcagccaccuggagugccggaccuuuuuccugacgcagggggcccuccugaacgacaagcacuccaacggcaccgugaaggaccgcagcccccaccggacccugauguccugcccggugggggaggcccccagucccuacaacucccgcuucgaaagcgucgcguggagcgccuccgccugccacgacggcaucaguuggcucaccaucgggaucuccggccccgacaacggcgccguggcggugcugaaguacaacgggaucaucacggacaccaucaagagcuggcggaacaacauccugcgcacccaggaguccgagugcgccugugucaacggcagcugcuucaccgugaugacggacgggccguccagcggccaggccuccuacaagaucuucaagauggaaaagggcaagguggucaagaguguggagcucgaggcccccaacuaccacuacgaggagugcuccugcuaccccgacgccggggaaaucacgugcgugugucgggacaacuggcacggcagcaaccgccccugggucuccuucaaccagaaccuggaguaucagaucggguacaucugcagcggcguguucggggacaacccgcggcccaacgacggcaccggcuccugcgggcccgugagucccaacggcgcguacggggucaagggcuucuccuucaaguacgggaacggcguguggaucggccgcaccaagagcaccaacucccggaguggguucgagaugaucugggacccgaacggcuggaccgggaccgacagcuccuucagcgugaagcaagacaucgucgccaucaccgacugguccggcuauagcggguccuucgugcagcaccccgagcugacgggccucgacugcauccgccccugcuucugggucgagcugauccggggccgccccaaggagagcaccaucuggaccuccgggaguuccaucagcuucugcggcgugaacuccgacaccgugagcugguccuggccggacggggccgagcugcccuucacgaucgacaaguga

SEQ ID NO: 18985 - RNA, 1350 nt, Artificial Sequence
  derived and/or modified CDS sequence (AUadapt) from InfluenzaA__ACJ53876__NA
augaaucccaaccaaaagaucaucaccaucggcagcaucugcauggugaucgggaucgucucccugaugcuccagaucggcaacaucaucagcaucugggugucccacagcauccagaccgggaaucagugccaggccgagccgaucuccaacacgaaguuccugaccgaaaaggccguggcgagcgucacccuggccggcaacuccagccucugccccaucuccgggugggccguguauagcaaggacaacuccauccgcaucggcagccggggcgacguguucgucauccgcgagcccuucaucuccugcagucaccuggagugccggaccuucuuccugacgcagggggcccuccugaacgacaagcacuccaauggcaccgugaaggaccgcagcccccaccggacccugauguccugcccggugggggaggcccccagccccuacaacucccgcuuugaaagcgucgcguggagcgccuccgccugccacgacggcaccagcuggcucacgaucgggaucuccggccccgacaacggcgccguggcggugcugaaguauaacgggaucaucaccgacaccaucaagagcuggcggaacaacauccugcgcacccaggaguccgagugcgccugcgucaauggcagcugcuucacggugaugaccgacgggccguccagcggccaggccuccuacaagaucuucaaaauggagaagggcaagguggucaagagcguggagcucgaugcccccaacuaccacuacgaggagugcuccugcuaccccgaugccggggagaucacgugcgugugccgggacaacuggcacggcagcaaccgccccugggucuccuuuaaccaaaaccuggaguaccagaucggguacaucugcagcggcguguucggggacaauccgcggcccaacgacggcaccggcuccugcgggcccgugagccccaacggcgcguacggggucaagggcuucuccuuuaaguacgggaacggcguguggaucggccgcaccaagagcaccaacucccggagcggguucgagaugaucugggacccgaauggcuggaccgggaccgacagcuccuucagcgugaagcaagacaucgucgccaucacggacugguccggcuacagcggguccuuugugcagcaccccgagcugaccggccucgacugcauccgccccugcuucugggucgagcugauccggggccgccccaaggagagcaccaucuggaccuccgggagcuccaucaguuucugcggcgugaacuccgacacggugggguggagcuggccggacggcgccgagcugcccuucaccaucgacaaguga

SEQ ID NO: 18986 - RNA, 1404 nt, Artificial Sequence
  derived and/or modified CDS sequence (AUadapt) from InfluenzaA__ACJ67535__NA
augaaccccaaccagaagaucaucgcccugggcucgguguccaucaccaucgccaccaucugccucaucaugcagaucgcgguccuggccacgaccaugacccugcacuucaacgagugcaccaacccgucgaacaaccaggccaugcccugcgagcccaucaucaucgagcgcaacaugacggagaucgugcaccucaacaacaccaccaucgagaaggaguccugccccaagguggccgaguacaagaacuggucgaagccgcagugccagaucaccggguucgcccccuucuccaaggacaacucgauccggcuguccgcgggcggggacaucugggucacgcgcgagcccuacgugucgugcggccuggggaacugcuaccaguucgcccucggccagggcaccacccugaacaacaagcacuccaacgacaccauccacgaccggagcccccaccgcacgcugcucaugaacgagcugggggugccguuccaccugggcaccaagcaggucugcaucgccugguccucguccucgugccacgacgggaaggccuggcuccacgugugcgugaccggcgacgaccggaacgcgaccgccuccaucaucuacgacgggaugcugacggacucgaucggcuccuggucgaagaacauccugcgcacccaggaguccgagugcgucugcaucaacgggaccugcaccguggugaugacggacgggagcgccucgggccgggccgacaccaagauccucuucauccgcgaggggaagaucguccacaucucgccccuguccggcuccgcccagcacguggaggagugcucgugcuacccccgguaccccgaggugcgcugcgucugccgggacaacuggaagggcuccaaccgcccggugcuguacaucaacguggcggacuacucggucgacuccagcuacgugugcuccgggcucgugggcgacacgccccggaacgacgacucguccucguccucgaacugccgcgaccccaacaacgagcggggcggccccggggucaagggcugggccuucgacaacggcaacgacguguggauggggcgcaccaucaagaaggacucccggucgggcuacgagaccuuccgcguggucgggggcuggaccaccgccaacuccaagagccagaucaaccgccaggugaucgucgacuccgacaacuggucgggguacucgggcaucuucuccguggagggcaagaccugcaucaaccggugcuucuacguggagcugauccgggggcgcccgcaggagacgcgcgucugguggaccucgaacuccaucaucguguucugcggcaccucggggaccuacggcacgggguccuggcccgacggcgccaacaucaacuucaugagcaucuga

SEQ ID NO: 18987 - RNA, 1410 nt, Artificial Sequence
  derived and/or modified CDS sequence (AUadapt) from InfluenzaA__ACK99424__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugauccccugccagcccacgaucaucgagcgcaacaucaccgagaucgucuaccucaccaacaccacgaucgagaaggagaucugcccgaagcugguggaguaccggaacuggucgaagccccagugcaagaucaccggguucgcgcccuucuccaaggacaacagcauccgccuguccgccggcggggacaucugggugacccgggagcccuacgucucgugcgacccguccaagugcuaccaguucgcccucggccaggggaccacgcugaacaaccgccacagcaacgacaccgugcacgaccggacccccuaccgcacccugcucaugaacgagcugggcgugcccuuccaccugggcacgaagcaggucugcaucgccugguccucguccagcugccacgacgggaaggccuggcuccacgugugcgugaccggccacgacgagaacgcgaccgccuccuucaucuacgacgggcggcuggucgacucgaucggcuccuggagcaagaacauccugcgcacccaggaguccgagugcgugugcaucaacgggacgugcaccguggucaugaccgacggcucggccagcgagcgggccgacaccaagauccucuucaucgaggagggcaagguggugcacaucagcccccuguccggguccgcgcagcacgucgaggagugcucgugcuacccgcgcuaccccggcgugcggugcgugugccgcgacaacuggaagggguccaaccggcccaucgucgacaucaacgugaaggacuacagcaucguguccucguacgucugcuccggccuggugggcgacacgccccgcaagaacgacagcuccucguccagcuacugccggaacccgaacaacgagaaggggucccacggcgucaaggggugggccuucgacgacggcaacgacguguggauggggcgcaccaucucggaggagcuccgguccggcuacgagaccuucaaggugaucggcggguggagcacccccaacuccaagcugcagaucaaccgccaggucaucguggacucgggcaaccggagcggguacuccggcaucuucucgguggaggggaaguccugcaucaaccgcugcuucuacgucgagcugauccggggccgcaagcaggagacgaaggugugguggaccagcaacuccaucguggucuucugcggcaccagcgggaccuacggcacgggguccuggcccgacggcgccgacaucaaccucaugcccaucuga

SEQ ID NO: 18988 - RNA, 1410 nt, Artificial Sequence; identical to SEQ ID NO: 18807
  derived and/or modified CDS sequence (AUadapt) from InfluenzaA__ACK99435__NA

SEQ ID NO: 18989 - RNA, 1413 nt, Artificial Sequence
  derived and/or modified CDS sequence (AUadapt) from InfluenzaA__ACK99446__NA
augaaccccaaccagaagaucaucaccaucggcucgaucuccauggccaucgggaucaucucgcugacccuccagaucggcaacaucaucuccaucugggugagccacuccauccagacggggucgcagaaccacaccggcaucugcaaccagcgcaucaucaccuacgagaacuccaccugggucaaccagacguacgugaacaucaacaacaccaacguggucgccgggaaggacaagaccagcgugacccuggcgggcaacuccucgcugugcccgauccggggcugggccaucuacacgaaggacaacuccauccgcaucgggucgaagggcgacguguucgucauccgggagcccuucaucuccugcagccaccucgagugccgcaccuucuuccugacccagggggcccugcucaacgacaagcacuccaacggcaccgugaaggaccggucgccccaccgcgcccugauguccugcccccugggggaggccccgagccccuacaacucccgguucgagucgguggcguggagcgccuccgccugccacgacggcaugggcuggcucacgaucgggaucucgggccccgacgacggggccgucgcggugcugaaguacaacggcaucaucaccgagaccaucaaguccuggaagaagcgcauccugcggacccaggagucggagugcgugugcgucaacggcuccugcuucacgaucaugaccgacgggcccagcaacggcgccgccuccuaccgcaucuucaagaucgagaaggggaaggugaccaagucgaucgagcucgacgccccgaacucccacuacgaggagugcagcugcuaccccgacaccggcacggugaugugcgucugccgggacaacuggcacggguccaaccgccccugggugucguucaaccagaaccuggacuaccagaucggcuacaucugcuccggcguguucggggacaacccccggccgaaggacggcaaggggagcugcaaccccgucaccguggacggcgccgacggggugaagggcuucuccuaccgcuacggcaacggggucuggaucggccggaccaagucgaaccgcuuccggaagggguucgagaugaucugggaccccaacggcuggaccgacacggacuccgacuucucggugaagcaggacguggucgcgaugaccgacugguccggguacagcggcucguucgugcagcaccccgagcugaccggccucgacugcaugcgcccgugcuucugggucgagcuggugcgggggcgcccccgggagaacaccacgaucuggaccuccggcagcuccaucucguucugcggggugaacuccgacaccgccaacuggagcuggcccgacggcgccgagcugcccuucaccaucgacaaguga

SEQ ID NO: 18990 - RNA, 1410 nt, Artificial Sequence
  derived and/or modified CDS sequence (AUadapt) from InfluenzaA__ACK99457__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcccugcgagcccacgaucaucgagcgcaacaucaccgagaucgucuaccucaccaacaccacgaucgagaaggagaucugcccgaagcugguggaguaccggaacugguccaagccccagugcaagaucaccggguucgcgcccuucagcaaggacaacuccauccgccugucggccggcggggacaucugggugacccgggagcccuacgucuccugcgacccgggcaagugcuaccaguucgcccucgggcagggcaccacgcugaacaaccgccacucgaacgacaccgugcacgaccggacccccuaccgcacccugcucaugaacgagcugggcgugcccuuccaccuggggacgaagcaggucugcaucgccugguccagcuccucgugccacgacggcaaggccuggcuccacgugugcgugaccgggcacgacgagaacgcgaccgccuccuucaucuacgacggccggcuggucgacagcaucguguccuggucgaagaacauccugcgcacccaggaguccgagugcgugugcaucaacgggacgugcaccgucgugaugaccgacggcucggccuccgagcgggccgacaccaagauccucuucaucgaggagggcaagaucgugcacaucagcccccugucgggguccgcgcagcacgucgaggagugcucgugcuacccgcgcuaccccggcgugcggugcgugugccgcgacaacuggaagggguccaaccggcccaucgucgacaucaacgugaaggacuacagcaucguguccucguacgucugcuccggccuggugggcgacacgccccgcaagaacgacagcuccucguccucguacugccggaacccgaacaacgagaaggggucccacggcgucaaggggugggccuucgacgacggcaacgacguguggauggggcgcaccaucggcgaggagcuccggagcggcuacgagaccuucaaggugaucgggggcugguccacccccaacucgaagcugcagacgaaccgccaggucaucguggaccgggggaaccgcuccggcuacucggggaucuucuccguggagggcaagagcugcaucaaccggugcuucuacgucgagcugauccgcggccgcaagcaggagaccaaggugugguggaccucgaacuccaucguggucuucugcgggaccagcggcacguacgggaccggcuccuggcccgacggggccgacaucaaccucaugcccaucuga

SEQ ID NO: 18991 - RNA, 1413 nt, Artificial Sequence
  derived and/or modified CDS sequence (AUadapt) from InfluenzaA__ACK99468__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaaccagaccuacgucaacaucaacaacacgaacgugguggcggggaaggacaagaccucgaugacccuggccggcaacuccagccugugcccgauccggggcugggccaucuacaccaaggacaacuccauccgcaucgggucgaagggcgacgucuucgugauccgggagcccuucaucuccugcagccaccucgagugccgcacguucuuccugacccagggggcccugcucaacgacaagcacuccaacggcaccgugaaggaccggucgcccuaccgcgcccugauguccugcccccugggggaggcgccgagccccuacaacucccgguucgagucggucgccuggagcgccuccgccugccacgacggccucggcuggcugaccaucgggaucucgggccccgacaacggggcgguggccgugcugaaguacaacggcaucaucacggagaccaucaaguccuggaagaagcgcauccuccggacccaggagagcgagugcgucugcaugaacuccucgugcuucaccaucaugacggacggccccuccaacggggccgccagcuaccgcaucuucaagaucgagaagggccgggugaccaaguccaucgagcuggacgccccgaacuaccacuacgaggagugcucgugcuaccccgacaccgggaccgugaugugcgucugccgcgacaacuggcacggcuccaaccggcccugggugagcuucaaccagaaccuggacuaccagaucggguacaucugcuccggcguguucggcgacaacccccgcccgaaggacggggagggcucgugcaaccccgucacgguggacggggcggacggcgugaagggguucuccuaccgguacggcaacggcgucuggaucgggcgcaccaagagcaaccggcuccgcaagggcuucgagaugaucugggaccccaacggguggaccgacaccgacuccgacuucucgaugaagcaggacaucguggccaugacggacugguccggcuacagcgggucguucgugcagcaccccgagcugaccggccuggacugcaugcggccgugcuucugggucgagcucgugcgcggccugccccgggagaacaccaccaucuggacguccgggagcuccaucucguucugcggcgugaacuccgacaccgccaacuggagcuggcccgacggggccgagcugcccuucaccaucgacaaguga

SEQ ID NO: 18992 - RNA, 1410 nt, Artificial Sequence
  derived and/or modified CDS sequence (AUadapt) from InfluenzaA__ACK99479__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaagaucaccggguucgcccccuucagcaaggacaacuccauccgccucucggccggcggggacaucugggugacccgggagcccuacguguccugcgaccccgacaagugcuaccaguucgcccugggccaggggaccacgcugaacaaccgccacagcaacgacaccguccacgaccggaccccguaccgcacccuccugaugaacgagcugggcgugcccuuccaccucggcacgaagcaggucugcaucgccugguccucguccucgugccacgacgggaaggcguggcugcacgugugcgugaccggccacgacgagaacgccaccgccuccuucaucuacgacgggcggcugguggacagcaucggcuccuggucgaagaagauccuccgcacccaggaguccgagugcgucugcaucaacgggacgugcaccguggugaugaccgacggcagcgccuccggccgggcggacaccaagauccuguucaucgaggaggggaagaucguccacaucucgccccugcucggcagcgcccagcacguggaggagugcuccugcuacccccgcuacccgggggugcggugcgucugccgcgacaacuggaagggcucgaaccggcccaucguggacaucaacgugaaggacuacuccaucgucucguccuacgugugcagcggccuggugggggacacgccccgcaagaacgacuccucguccagcucccacugccugaaccccaacaacgaggagggcgggcacggcgucaaggggugggccuucgacgacggcaacgacguguggaugggccggaccaucucggagaagcuccgcuccggguacgagaccuucaaggucaucgagggcuggucgaagccgaacuccaagcugcagaucaaccgccaggugaucguggaccgggggaaccggagcggcuacuccgggaucuucucggucgagggcaaguccugcaucaaccgcugcuucuacguggagcugauccggggccgcaagcaggagaccgaggugugguggacgagcaacucgaucgucguguucugcgggaccuccggcaccuacgggaccggcagcuggcccgacggggccaacaucaaccucaugcccaucuga

SEQ ID NO: 18993 - RNA, 1413 nt, Artificial Sequence; identical to SEQ ID NO: 18686
  derived and/or modified CDS sequence (AUadapt) from InfluenzaA__ACL12066__NA

SEQ ID NO: 18994 - RNA, 1410 nt, Artificial Sequence; identical to SEQ ID NO: 17587
  derived and/or modified CDS sequence (AUadapt) from InfluenzaA__ACL12132__NA

SEQ ID NO: 18995 - RNA, 1413 nt, Artificial Sequence; identical to SEQ ID NO: 18920
  derived and/or modified CDS sequence (AUadapt) from InfluenzaA__ACL12154__NA

SEQ ID NO: 18996 - RNA, 1410 nt, Artificial Sequence; identical to SEQ ID NO: 18914
  derived and/or modified CDS sequence (AUadapt) from InfluenzaA__ACL12165__NA

SEQ ID NO: 18997 - RNA, 1410 nt, Artificial Sequence; identical to SEQ ID NO: 18914
  derived and/or modified CDS sequence (AUadapt) from InfluenzaA__ACL12176__NA

SEQ ID NO: 18998 - RNA, 1410 nt, Artificial Sequence
  derived and/or modified CDS sequence (AUadapt) from InfluenzaA__ACL12198__NA
augaaccccaaccagaagaucaucaccaucggcucggugucccugaccaucagcacgaucugcuucuucaugcagaucgccauccucaucaccaccgucacccugcacuucaagcaguacgaguucaacuccacgccgaacaaccaggugaugcugugcgagcccaccaucaucgagcgcaacaucaccgagaucguguaccucaccaacacgaccaucgagaaggagaucugccccaagcuggccgaguaccggaacuggucgaagccccagugcgacaucaccggguucgcgccguucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccgcgaccggacccccuaccgcacgcugcucaugaacgagcugggcgugccguuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccucgaccccaacaacgaggagggcggccacggggucaagggcugggccuucgacgacgggaacgacguguggaugggccgcacgaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcacguccgggaccuacggcaccgggagcuggcccgacggcgccgacaucaaccugaugccgaucuga

SEQ ID NO: 18999 - RNA, 1410 nt, Artificial Sequence; identical to SEQ ID NO: 18492
  derived and/or modified CDS sequence (AUadapt) from InfluenzaA__ACL12209__NA

SEQ ID NO: 19000 - RNA, 1410 nt, Artificial Sequence; identical to SEQ ID NO: 18914
  derived and/or modified CDS sequence (AUadapt) from InfluenzaA__ACL12220__NA

SEQ ID NO: 19001 - RNA, 1410 nt, Artificial Sequence
  derived and/or modified CDS sequence (AUadapt) from InfluenzaA__ACL12242__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19002 - RNA, 1413 nt, Artificial Sequence
  derived and/or modified CDS sequence (AUadapt) from InfluenzaA__ACL12264__NA
augaaccccaaccagaagaucaucaccaucggcucgaucuccauggccaucgggaucaucagccugauccuccagaucgugaacaucaucuccaucugggucucgcacuccauccagaccggcagccagaaccacacggggaucugcaaccagcgcaucaucaccuacgagaacuccaccugggugaaccagaccuacgugaacaucaacaacacgaacgucguggccggcaaggacaagaccucggugacccuggcggggaacuccagccugugcccgauccggggcugggccaucuacaccaaggacaacuccauccgcaucggcucgaagggggacgucuucgugauccgggagcccuucaucuccugcagccaccucgagugccgcacguucuuccugacccagggcgcccugcucaacgacaagcacuccaacgggaccgugaaggaccggucgcccuaccgcgcccugauguccugcccccugggcgaggccccgagccccuacaacucccgguucgagucggucgcguggagcgccuccgccugccacgacgggaugggcuggcucaccaucggcaucagcgggcccgacgacggcgccguggcggugcugaaguacaacgggaucaucacggagaccaucaaguccuggaagaagcgcauccugcggacccaggagucggagugcgucugcgugaacggcuccugcuucaccaucaugacggacggccccagcaacggggccgccuccuaccgcaucuucaagaucgagaagggcaaggugaccaagucgaucgagcucgacgccccgaacucccacuacgaggagugcagcugcuaccccgacaccgggaccgucaugugcgugugccgggacaacuggcacggcuccaaccgccccugggugucguucaaccagaaccuggacuaccagaucggguacaucugcuccggcgucuucggcgacaacccccggccgaaggacgggaagggcagcugcgaccccgugacgguggacggggccgacggcgucaagggguucuccuaccgcuacggcaacggcguguggaucgggcggaccaagucgaaccgcuuccggaagggcuucgagaugaucugggaccccaacggguggaccgacaccgacuccgacuucagcgugaagcaggacgucguggcgaugacggacugguccggcuacucggggagcuucguccagcaccccgagcugaccggccucgacugcaugcgcccgugcuucuggguggagcuggugcggggccgcccccgggagaacaccaccaucuggacguccgggucguccaucagcuucugcggcgucaacuccgacaccgccaacuggagcuggcccgacggggccgagcugcccuucaccaucgacaaguga

SEQ ID NO: 19003 - RNA, 1410 nt, Artificial Sequence; identical to SEQ ID NO: 18807
  derived and/or modified CDS sequence (AUadapt) from InfluenzaA__ACN32275__NA

SEQ ID NO: 19004 - RNA, 1410 nt, Artificial Sequence
  derived and/or modified CDS sequence (AUadapt) from InfluenzaA__ACN32286__NA
augaaccccaacaagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccugcugggguccgcgcagcacguggaggagugcucgugcuacccccgguaccccggcgugcgcugcgucugccgggacaacuggaagggguccaaccgcccgaucguggacaucaacaucaaggaccacagcaucguguccucguacgucugcuccggccucgugggcgacacgccccggaagaacgacagcuccucguccgggcacugccuggaccccaacaacgaggagggcgggcacggcgugaaggggugggccuucgacgacggcaacgacgucuggaugggccgcaccaucagcgagaagucccggcugggguacgagaccuucaaggugaucgagggcuggucgaaccccaaguccaagcuccagaucaaccgccaggucaucguggaccgggggaaccgcagcggcuacuccgggaucuucucgguggagggcaaguccugcaucaaccggugcuucuacgucgagcugauccgcggccggaaggaggagaccgaggugcuguggaccagcaacucgaucguggucuucugcgggaccuccggcacguacgggaccggcagcuggccggacggggccgacaucaaccucaugcccaucuga

SEQ ID NO: 19005 - RNA, 1410 nt, Artificial Sequence
  derived and/or modified CDS sequence (AUadapt) from InfluenzaA__ACN32493__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcaucguguccuggucgaaggagauccugcgcacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcucgugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccagcuccucgcacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 19006 - RNA, 1410 nt, Artificial Sequence; identical to SEQ ID NO: 16556
  derived and/or modified CDS sequence (AUadapt) from InfluenzaA__ACN32526__NA

SEQ ID NO: 19007 - RNA, 1410 nt, Artificial Sequence
  derived and/or modified CDS sequence (AUadapt) from InfluenzaA__ACN32537__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccgacgugcgcugcgucugccgggacaacuggaagggcuccaaccgcccgaucguggacaucaacgugaaggacuacagcaucgucuccucguacgugugcuccggccucgugggggacacgccccggaagaacgacagcuucuccucgucccacugccuggaccccaacaacgaggagggcgggcacggcgucaaggggugggccuucgacgacggcaacgacguguggaugggccgcaccaucagcgagaagcugcgguccggguacgagaccuucaaggucaucgacggcuggucgaagcccaacuccaagcuccagaucaaccgccaggugaucguggagcgggggaaccgcagcggcuacuccgggaucuucucggucgagggcaaguccugcaucaaccggugcuucuacguggagcugauccgcggccggaaggaggagaccgaggugugguggaccagcaacucgaucgucguguucugcgggaccuccggcaccuacgggacgggcagcuggccggacggggccgacaucaaccugaugcccaucuga

SEQ ID NO: 19008 - RNA, 1413 nt, Artificial Sequence; identical to SEQ ID NO: 18484
  derived and/or modified CDS sequence (AUadapt) from InfluenzaA__ACN32807__NA

SEQ ID NO: 19009 - RNA, 1413 nt, Artificial Sequence; identical to SEQ ID NO: 18432
  derived and/or modified CDS sequence (AUadapt) from InfluenzaA__ACN32818__NA

SEQ ID NO: 19010 - RNA, 1413 nt, Artificial Sequence; identical to SEQ ID NO: 18432
  derived and/or modified CDS sequence (AUadapt) from InfluenzaA__ACN32829__NA

SEQ ID NO: 19011 - RNA, 1413 nt, Artificial Sequence
  derived and/or modified CDS sequence (AUadapt) from InfluenzaA__ACN32840__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucagcaucaacaacacgaacgugguggcggggaaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacggagaccaucaagagcuggaagaagcgcauccugcggacccaggaguccgagugcgugugcgugaacggcagcugcuucaccaucaugacggacgggcccuccaacggcgccgccucguacaagaucuucaagaucgagaaggggaaggucaccaaguccaucgagcucaacgcccccaacuuccacuacgaggagugcagcugcuacccggacaccggcaccgugaugugcgugugccgcgacaacuggcacggguccaaccggcccugggucucguucaaccagaaccuggacuaccagaucggcuacaucugcuccggcguguucggggacaacccccgccccaaggacggcaaggggagcugcaacccggugacggucgacggcgcggacggggugaagggcuucuccuacaaguacggcaacgggguguggaucggccggaccaagagcaaccgccugcggaagggguucgagaugaucugggaccccaacggcuggaccgacaccgacuccgacuucucggucaagcaggacgugguggccaucacggacuggagcggguacuccggcagcuucguccagcaccccgagcucaccggccuggacugcauccgccccugcuucuggguggagcugguccgggggcucccgcgcgagaacaccaccaucuggacguccggcucguccaucagcuucugcgggguggacuccgacaccgugaacuggagcuggcccgacggcgccgagcugcccuucaccaucgacaaguga

SEQ ID NO: 19012 - RNA, 1410 nt, Artificial Sequence; identical to SEQ ID NO: 18914
  derived and/or modified CDS sequence (AUadapt) from InfluenzaA__ACN32851__NA

SEQ ID NO: 19013 - RNA, 1410 nt, Artificial Sequence; identical to SEQ ID NO: 19001
  derived and/or modified CDS sequence (AUadapt) from InfluenzaA__ACN32862__NA

SEQ ID NO: 19014 - RNA, 1410 nt, Artificial Sequence; identical to SEQ ID NO: 19005
  derived and/or modified CDS sequence (AUadapt) from InfluenzaA__ACN32873__NA

SEQ ID NO: 19015 - RNA, 1410 nt, Artificial Sequence; identical to SEQ ID NO: 19001
  derived and/or modified CDS sequence (AUadapt) from InfluenzaA__ACN32884__NA

SEQ ID NO: 19016 - RNA, 1410 nt, Artificial Sequence; identical to SEQ ID NO: 19005
  derived and/or modified CDS sequence (AUadapt) from InfluenzaA__ACN32895__NA

SEQ ID NO: 19017 - RNA, 1410 nt, Artificial Sequence; identical to SEQ ID NO: 18914
  derived and/or modified CDS sequence (AUadapt) from InfluenzaA__ACN32906__NA

SEQ ID NO: 19018 - RNA, 1410 nt, Artificial Sequence
  derived and/or modified CDS sequence (AUadapt) from InfluenzaA__ACN32917__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcaagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaccgaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 19019 - RNA, 1410 nt, Artificial Sequence
  derived and/or modified CDS sequence (AUadapt) from InfluenzaA__ACN32928__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaccgaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaaccugaugcccaucuga

SEQ ID NO: 19020 - RNA, 1410 nt, Artificial Sequence; identical to SEQ ID NO: 19005
  derived and/or modified CDS sequence (AUadapt) from InfluenzaA__ACN32939__NA

SEQ ID NO: 19021 - RNA, 1410 nt, Artificial Sequence; identical to SEQ ID NO: 18914
  derived and/or modified CDS sequence (AUadapt) from InfluenzaA__ACN32950__NA

SEQ ID NO: 19022 - RNA, 1410 nt, Artificial Sequence
  derived and/or modified CDS sequence (AUadapt) from InfluenzaA__ACN32961__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaccgaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcacguccgggaccuacggcaccgggagcuggccggacggcgccgacaucaacaucaugcccaucuga

SEQ ID NO: 19023 - RNA, 1410 nt, Artificial Sequence; identical to SEQ ID NO: 19001
  derived and/or modified CDS sequence (AUadapt) from InfluenzaA__ACN32972__NA

SEQ ID NO: 19024 - RNA, 1410 nt, Artificial Sequence; identical to SEQ ID NO: 19001
  derived and/or modified CDS sequence (AUadapt) from InfluenzaA__ACN32994__NA

SEQ ID NO: 19025 - RNA, 1410 nt, Artificial Sequence
  derived and/or modified CDS sequence (AUadapt) from InfluenzaA__ACN33005__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggggagucgugcaucaaccggugcuucuacguggagcucauccgcggccggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19026 - RNA, 1410 nt, Artificial Sequence; identical to SEQ ID NO: 19001
  derived and/or modified CDS sequence (AUadapt) from InfluenzaA__ACN33016__NA

SEQ ID NO: 19027 - RNA, 1410 nt, Artificial Sequence; identical to SEQ ID NO: 19001
  derived and/or modified CDS sequence (AUadapt) from InfluenzaA__ACN33049__NA

SEQ ID NO: 19028 - RNA, 1410 nt, Artificial Sequence; identical to SEQ ID NO: 19001
  derived and/or modified CDS sequence (AUadapt) from InfluenzaA__ACN33060__NA

SEQ ID NO: 19029 - RNA, 1410 nt, Artificial Sequence; identical to SEQ ID NO: 19005
  derived and/or modified CDS sequence (AUadapt) from InfluenzaA__ACN33082__NA

SEQ ID NO: 19030 - RNA, 1413 nt, Artificial Sequence; identical to SEQ ID NO: 18471
  derived and/or modified CDS sequence (AUadapt) from InfluenzaA__ACN33093__NA

SEQ ID NO: 19031 - RNA, 1413 nt, Artificial Sequence; identical to SEQ ID NO: 18432
  derived and/or modified CDS sequence (AUadapt) from InfluenzaA__ACN33104__NA

SEQ ID NO: 19032 - RNA, 1410 nt, Artificial Sequence; identical to SEQ ID NO: 19005
  derived and/or modified CDS sequence (AUadapt) from InfluenzaA__ACN33115__NA

SEQ ID NO: 19033 - RNA, 1413 nt, Artificial Sequence
  derived and/or modified CDS sequence (AUadapt) from InfluenzaA__ACN33126__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcuccucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuuccacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucucggugaagcaggacgucguggccaucaccgacuggagcggcuacuccgggagcuucgugcagcaccccgagcucacgggccuggacugcauccggcccugcuucugggucgagcuggugcgcggccucccgcgggagaacaccaccaucuggaccuccgggucguccaucagcuucugcggcgucaacuccgacacggccaacuggagcuggcccgacggggccgagcugcccuucaccaucgacaaguga

SEQ ID NO: 19034 - RNA, 1413 nt, Artificial Sequence
  derived and/or modified CDS sequence (AUadapt) from InfluenzaA__ACN33148__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 19035 - RNA, 1410 nt, Artificial Sequence
  derived and/or modified CDS sequence (AUadapt) from InfluenzaA__ACN33159__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcaccuccgggacguacggcaccgggagcuggccggacggcgccgacaucaaccugaugcccaucuga

SEQ ID NO: 19036 - RNA, 1410 nt, Artificial Sequence; identical to SEQ ID NO: 18914
  derived and/or modified CDS sequence (AUadapt) from InfluenzaA__ACN33170__NA

SEQ ID NO: 19037 - RNA, 1410 nt, Artificial Sequence; identical to SEQ ID NO: 19005
  derived and/or modified CDS sequence (AUadapt) from InfluenzaA__ACN33181__NA

SEQ ID NO: 19038 - RNA, 1410 nt, Artificial Sequence; identical to SEQ ID NO: 19005
  derived and/or modified CDS sequence (AUadapt) from InfluenzaA__ACN33203__NA

SEQ ID NO: 19039 - RNA, 1410 nt, Artificial Sequence
  derived and/or modified CDS sequence (AUadapt) from InfluenzaA__ACN33214__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaccguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccaucuga

SEQ ID NO: 19040 - RNA, 1413 nt, Artificial Sequence; identical to SEQ ID NO: 18473
  derived and/or modified CDS sequence (AUadapt) from InfluenzaA__ACN42984__NA

SEQ ID NO: 19041 - RNA, 1413 nt, Artificial Sequence; identical to SEQ ID NO: 18473
  derived and/or modified CDS sequence (AUadapt) from InfluenzaA__ACN42995__NA

SEQ ID NO: 19042 - RNA, 1410 nt, Artificial Sequence
  derived and/or modified CDS sequence (AUadapt) from InfluenzaA__ACN43006__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccgcgugaugcugugcgagcccacgaucaucgagcggaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19043 - RNA, 1410 nt, Artificial Sequence; identical to SEQ ID NO: 19005
  derived and/or modified CDS sequence (AUadapt) from InfluenzaA__ACN43017__NA

SEQ ID NO: 19044 - RNA, 1410 nt, Artificial Sequence; identical to SEQ ID NO: 19001
  derived and/or modified CDS sequence (AUadapt) from InfluenzaA__ACN43028__NA

SEQ ID NO: 19045 - RNA, 1410 nt, Artificial Sequence
  derived and/or modified CDS sequence (AUadapt) from InfluenzaA__ACN43039__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccuggagacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucggggaaggccgacaccaagauccucuucaucgaggagggcaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcgggcuggugggcgacacgccccggaagaacgacuccucguccagcucccacugccucgaccccaacaacgaggagggcgggcacggcgucaaggggugggccuucgacgacggcaacgacguguggauggggcgcaccaucucggagaagucccggcugggcuacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 19046 - RNA, 1410 nt, Artificial Sequence; identical to SEQ ID NO: 18914
  derived and/or modified CDS sequence (AUadapt) from InfluenzaA__ACN43050__NA

SEQ ID NO: 19047 - RNA, 1410 nt, Artificial Sequence; identical to SEQ ID NO: 19001
  derived and/or modified CDS sequence (AUadapt) from InfluenzaA__ACN43061__NA

SEQ ID NO: 19048 - RNA, 1410 nt, Artificial Sequence
  derived and/or modified CDS sequence (AUadapt) from InfluenzaA__ACN43072__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcgucgugguguucugcggcaccuccgggacguacggcaccgggagcuggccggacggcgccgacaucaaccugaugcccaucuga

SEQ ID NO: 19049 - RNA, 1410 nt, Artificial Sequence
  derived and/or modified CDS sequence (AUadapt) from InfluenzaA__ACN43083__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcaucguguccuggucgaacgagauccugcgcacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcucgugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccagcuccucgcacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 19050 - RNA, 1410 nt, Artificial Sequence; identical to SEQ ID NO: 16729
  derived and/or modified CDS sequence (AUadapt) from InfluenzaA__ACN50231__NA

SEQ ID NO: 19051 - RNA, 1410 nt, Artificial Sequence
  derived and/or modified CDS sequence (AUadapt) from InfluenzaA__ACN50233__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccgugguccucaccgacggguccgccucgggcaaggccgacaccaagauccuguucaucgaggagggcaagaucgugcacacgagcaagcuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccucgugggcgacacgccccgcaagaacgacuccagcuccucggggcacugccuggaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcuccagaucaaccgccaggugaucguggaccgggggaaccgguccggcuacagcgggaucuucuccgucgagggcaagucgugcaucaaccgcugcuucuacguggagcugauccggggccgcaaggaggagaccgaggugcuguggaccagcaacuccaucgucguguucugcgggaccagcggcaccuacgggacgggcuccuggccggacggggccgacaucaaccucaugcccaucuga

SEQ ID NO: 19052 - RNA, 1410 nt, Artificial Sequence
  derived and/or modified CDS sequence (AUadapt) from InfluenzaA__ACN50245__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccagguggugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcgaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19053 - RNA, 1413 nt, Artificial Sequence
  derived and/or modified CDS sequence (AUadapt) from InfluenzaA__ACN72609__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuacaagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 19054 - RNA, 1410 nt, Artificial Sequence
  derived and/or modified CDS sequence (AUadapt) from InfluenzaA__ACN72621__NA
augaaccccaaccagaagaucaucaucaucucguccaucugcaugaccaacggcaucgccagccugauccuccagaucgggaacaucaucuccaucuggaucagccacuccauccagaccggcaaccagaaccagacggagaccugcaaccagagcgugaucaucuacgagaacaacaccugggucaaccagaccuacgugaacaucuccaacaacaacuucguggccgagcagacggucgugccggugaagcuggucgggucgagcccccugugccccgugagcggcugggcgaucuacuccaaggacaacagcgugcgcaucggguccaagggcgacgucuucgugauccgggagcccuucaucucgugcucccaccucgagugccgcaccuucuuccugacccagggcgcccugcucaacgacaagcacagcaacgggaccgugaaggaccgguccccguaccgcacgcugaugagcugccccaucggcgagguccccucccccuacaacagccgguucgagucgguggccugguccgccagcgccugccacgacggguccagcuggcugaccaucggcaucuccgggccggacaacggcgcgguggccguccucaaguacaacgacaucaucaccgacaccaucaagagcuggaagaacaacauccugcgcacgcaggaguccgagugcgccugccugaacggcucgugcuucaccgugaugaccgacgggcccuccaacggccaggccagcuacaagaucuucaagaucgagaaggggaagguggucaaguccguggagcucaacgcgcccaacuaccacuacgaggagugcagcugcuaccccgacuccggcgagaucaucugcgugugccgggacaacuggcacggcagcaaccgcccgugggucuccuucaaccagaaccuggaguaccagaucggguacaucugcucgggcgugcugggggacaacccccggcccaacgaccgcaccggcaacugcgggcccguguccagccacggcgccaacggcgucaagggguucuccuucaaguacggcgacgggaucuggaucggccggacgaaguccaccagcucccgcagcggguucgagaugaucugggacccgaacggcuggaccggcaccgacaacaacuucuccgugaagcaggacaucgucgggaucacggacuggaccggcuacucgggguccuucgugcagcaccccgagcucaccggccuggacugcauccggcccugcuucuggguggagcugauccgcgggcggcccaaggagaacaccaucuggacgagcggcuccagcaucuccuucugcggcgucaacagcgacaccguggggugguccuggccggacggcgccgagcuccccuucaccaucgacaaguga

SEQ ID NO: 19055 - RNA, 1410 nt, Artificial Sequence; identical to SEQ ID NO: 18914
  derived and/or modified CDS sequence (AUadapt) from InfluenzaA__ACN76503__NA

SEQ ID NO: 19056 - RNA, 1410 nt, Artificial Sequence
  derived and/or modified CDS sequence (AUadapt) from InfluenzaA__ACO36345__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcagugcgagcccacgaucaucgagcgcaacaucaccgagaucguguaccugaccaacaccacgaucgagaaggagaucugccccaagcucgccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccugggccaggggaccacgcucaacaacgugcacagcaacaacaccguccgcgaccggacccccuaccgcacccugcugaugaacgagcucggcgugccguuccaccugggcacgaagcaggucugcaucgccugguccucguccagcugccacgacgggaaggccuggcugcacgugugcaucaccggcgacgacaagaacgcgaccgccuccuucaucuacaacgggcggcucguggacucgaucguguccuggagcaaggagauccugcgcacccaggaguccgagugcgucugcaucaacggcacgugcaccguggugaugaccgacgggucggccagcggcaaggccgacaccaagauccuguucaucgaggagggcaagaucguccacacguccacccucucgggguccgcgcagcacguggaggagugcagcugcuacccccgguaccccggcgugcgcugcgucugccgggacaacuggaagggguccaaccgccccaucguggacaucaacaucaaggaccacucgaucguguccagcuacgucugcuccggccuggugggcgacaccccgcggaagaacgacucguccagcuccucgcacugccuggaccccaacaacgaggagggcgggcacggggugaagggcugggccuucgacgacgggaacgacgucuggaugggccgcaccaucuccgagaagucccggcucggcuacgagacguucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcugauccgcggccggaaggaggagaccgaggugcucuggaccagcaacuccaucguggucuucugcggcaccagcgggacguacggcaccggguccuggcccgacggcgccgacaucaaccugaugccgaucuga

SEQ ID NO: 19057 - RNA, 1410 nt, Artificial Sequence; identical to SEQ ID NO: 17382
  derived and/or modified CDS sequence (AUadapt) from InfluenzaA__ACO36356__NA

SEQ ID NO: 19058 - RNA, 1410 nt, Artificial Sequence
  derived and/or modified CDS sequence (AUadapt) from InfluenzaA__ACO36367__NA
augaaccccaaccagaagaucaucaccaucggcucggugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugagcugguccaaggagauccugcgcacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguucggcaccgggagcuggccggacggcgccgacaucaaccugaugcccaucuga

SEQ ID NO: 19059 - RNA, 1413 nt, Artificial Sequence; identical to SEQ ID NO: 19034
  derived and/or modified CDS sequence (AUadapt) from InfluenzaA__ACO36400__NA

SEQ ID NO: 19060 - RNA, 1410 nt, Artificial Sequence
  derived and/or modified CDS sequence (AUadapt) from InfluenzaA__ACO36411__NA
augaaccccaaccagaagaucaucaccaucggcucggugucccugaccaucucgacgaucggguucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggcuucgcgcccuucuccaaggacaacucgauccgccuguccgccgggggcgacaucugggucacccgggagcccuacgugagcugcgaccccgacaagugcuaccaguucgcccucgggcagggcacgacccugaacaacgugcacuccaacgacaccguccgcggccggaccccguaccgcacgcugcucaugaacgagcugggggugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugucgugguccaaggagauccugcgcacgcaggagagcgagugcgucugcaucaacgggaccugcaccguggugaugaccgacggcuccgccucggggaaggccgacacgaagauccucuucaucgaggagggcaagaucguccacaccagcacccuguccgggucggcgcagcacguggaggagugcuccugcuacccccgguaccccggcgugcgcugcgucugccgggacaacuggaagggcagcaaccgcccgaucguggacaucaacaucaaggaccacuccaucgugucguccuacgucugcagcgggcuggugggcgacacgccccggaagaacgacuccucguccucgucccacugccucgaccccaacaacgaggagggcggccacggggugaagggcugggccuucgacgacggcaacgacgucuggauggggcgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 19061 - RNA, 1410 nt, Artificial Sequence
  derived and/or modified CDS sequence (AUadapt) from InfluenzaA__ACO36422__NA
augaaccccaaccagaagaucaucaccaucggcucggugucccugaucaucagcaccaucugcuucuucaugcagacggccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccaucgugucgugguccaaggagauccugcgcacccaggagagcgagugcgucugcaucaacgggacgugcaccguggugaugaccgacggcuccgccucgggcaaggccgacaccaagauccucuucaucgaggaggggaagaucguccacacgagcacccuguccggcucggcgcagcacguggaggagugcuccugcuacccccgguaccccggggugcgcugcgucugccgggacaacuggaagggcagcaaccgcccgaucguggacaucaacaucaaggaccacuccaucgugucguccuacgucugcagcggccuggugggggacacgccccggaagaacgacuccucguccagcucccacugccucgaccccaacaacgaggagggcgggcacggcgugaaggggugggccuucgacgacggcaacgacgucuggaugggccgcaccaucucggagaagucccggcugggguacgagaccuucaaggugaucgagggcuggagcaaccccaaguccaagcugcagaucaaccgccaggucaucguggaccgggggaaccgcucgggcuacuccgggaucuucagcguggagggcaagucgugcaucaaccggugcuucuacgucgagcucauccgcggccggaaggaggagaccgaggugcuguggaccuccaacagcaucguggucuucugcgggaccuccggcacguacgggaccggcagcuggccggacggggccgacaucaaccugaugcccaucuga

SEQ ID NO: 19062 - RNA, 1410 nt, Artificial Sequence; identical to SEQ ID NO: 18818
  derived and/or modified CDS sequence (AUadapt) from InfluenzaA__ACO36433__NA

SEQ ID NO: 19063 - RNA, 1410 nt, Artificial Sequence
  derived and/or modified CDS sequence (AUadapt) from InfluenzaA__ACO36444__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaagugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacaacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgagaaggcggacaccaagauccuguucaucgaggaggggaagaucguccacaucagcacgcugucgggcuccgcccagcacguggaggagugcucgugcuacccccgguaccccggggugcgcugcgucugccgggacaacuggaagggcuccaaccgcccgaucguggacaucaacgugaaggacuacagcaucgucuccucguacgugugcuccggccucgugggggacacgccccggaagaacgacagcuucuccucgucccacugccuggaccccaacaacgaggagggcgggcacggcgucaaggggugggccuucgacgacggcaacgacguguggaugggccgcaccaucucggagaagcugcgguccggguacgagaccuucaaggucaucgagggcuggagcaagcccaacuccaagcuccagaucaaccgccaggugaucguggagcgggggaaccgcucgggcuacuccgggaucuucucggucgagggcaaguccugcaucaaccggugcuucuacguggagcugauccgcggccggaaggaggagaccgaggugugguggaccagcaacucgaucgucguguucugcgggaccuccggcaccuacgggacgggcagcuggccggacggggccgacaucaaccugaugcccaucuga

SEQ ID NO: 19064 - RNA, 1410 nt, Artificial Sequence
  derived and/or modified CDS sequence (AUadapt) from InfluenzaA__ACO36466__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucgccuaccucaccaacaccacgaucgagaaggagaucugccccaagcuggcggaguaccggaacuggucgaagccgcagugcaacaucaccggguucgcccccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcaucgccuggagcuccucguccugccacgacgggaaggcguggcuccacgugugcgugaccggcgacgacgagaacgccaccgccagcuucaucuacaacgggcgccugguggacuccguggucucgugguccaagaagauccugcggacccaggagagcgagugcgugugcaucaacggcacgugcaccguggucaugaccgacggguccgccucgggcaaggcggacaccaagauccucuucaucgaggagggcaagaucgugcacacgagcacccuguccgggucggcccagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 19065 - RNA, 1410 nt, Artificial Sequence
  derived and/or modified CDS sequence (AUadapt) from InfluenzaA__ACO36477__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaacauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 19066 - RNA, 1410 nt, Artificial Sequence
  derived and/or modified CDS sequence (AUadapt) from InfluenzaA__ACO36499__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccgucgugagcugguccaagaagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaccaggagaccgagguccuguggaccuccaacagcaucgugguguucugcggcaccuccgggacguacggcaccgggagcuggccggacggcgccgacaucaaccugaugcccaucuga

SEQ ID NO: 19067 - RNA, 1410 nt, Artificial Sequence; identical to SEQ ID NO: 16729
  derived and/or modified CDS sequence (AUadapt) from InfluenzaA__ACO36510__NA

SEQ ID NO: 19068 - RNA, 1410 nt, Artificial Sequence; identical to SEQ ID NO: 16729
  derived and/or modified CDS sequence (AUadapt) from InfluenzaA__ACO36543__NA

SEQ ID NO: 19069 - RNA, 1410 nt, Artificial Sequence; identical to SEQ ID NO: 16729
  derived and/or modified CDS sequence (AUadapt) from InfluenzaA__ACO36554__NA

SEQ ID NO: 19070 - RNA, 1410 nt, Artificial Sequence; identical to SEQ ID NO: 16729
  derived and/or modified CDS sequence (AUadapt) from InfluenzaA__ACO36565__NA

SEQ ID NO: 19071 - RNA, 1410 nt, Artificial Sequence
  derived and/or modified CDS sequence (AUadapt) from InfluenzaA__ACO36576__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucgugggccgggggaaccggucgggcuacuccgggaucuucagcgucgagggcaagucgugcaucaaccgcugcuucuacguggagcucauccggggccgcaaggaggagaccgaggugcuguggaccuccaacagcaucgucguguucugcgggaccuccggcacguacgggaccggcagcuggccggacggggccgacaucaaccugaugcccaucuga

SEQ ID NO: 19072 - RNA, 1410 nt, Artificial Sequence; identical to SEQ ID NO: 16729
  derived and/or modified CDS sequence (AUadapt) from InfluenzaA__ACO36587__NA

SEQ ID NO: 19073 - RNA, 1410 nt, Artificial Sequence; identical to SEQ ID NO: 17114
  derived and/or modified CDS sequence (AUadapt) from InfluenzaA__ACO36609__NA

SEQ ID NO: 19074 - RNA, 1410 nt, Artificial Sequence
  derived and/or modified CDS sequence (AUadapt) from InfluenzaA__ACO36620__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcuccaggugaaccgccaggugaucgucgaccggggcaaccggucgggguacuccggcaucuucagcguggagggcaagucgugcaucaaccgcugcuucuacguggagcugauccgggggcgcaaggaggagaccgagguccuguggaccuccaacagcaucgugguguucugcggcaccuccgggacguacggcaccgggagcuggccggacggcgccgacaucaaccugaugcccaucuga

SEQ ID NO: 19075 - RNA, 1410 nt, Artificial Sequence; identical to SEQ ID NO: 17114
  derived and/or modified CDS sequence (AUadapt) from InfluenzaA__ACO36631__NA

SEQ ID NO: 19076 - RNA, 1410 nt, Artificial Sequence; identical to SEQ ID NO: 17114
  derived and/or modified CDS sequence (AUadapt) from InfluenzaA__ACO36653__NA

SEQ ID NO: 19077 - RNA, 1410 nt, Artificial Sequence
  derived and/or modified CDS sequence (AUadapt) from InfluenzaA__ACO36675__NA
augaaccccaaccagaagaucaucaccaucggcucggugucccugaccaucagcacgaucugccucuucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcaacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccucguccugccacgacgggaaggccuggcugcacgugugcgugaccggcgacgacaagaacgcgaccgccagcuucaucuacaacgggcgccugguggacuccaucgucucgugguccaaggagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccucgugggcgacacgccccgcaagaacgacuccucguccagcucccacugccuggaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 19078 - RNA, 1410 nt, Artificial Sequence
  derived and/or modified CDS sequence (AUadapt) from InfluenzaA__ACO36686__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccacgacaagugcuaccaguucgcccucggccaggggaccacgcugaacaacgugcacuccaacgacaccguccacgaccgcacccccuaccggacccugcucaugaacgagcugggcgugccguuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggcccaucguggacaucaacaucaaggacuacuccaucgucagcuccuacgugugcucgggccuggugggcgacaccccgcgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagacguucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggcccgacggcgccgacaucaaccugaugccgaucuga

SEQ ID NO: 19079 - RNA, 1410 nt, Artificial Sequence
  derived and/or modified CDS sequence (AUadapt) from InfluenzaA__ACO37125__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggaugcugguggacuccaucgucagcugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggacuacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19080 - RNA, 1410 nt, Artificial Sequence
  derived and/or modified CDS sequence (AUadapt) from InfluenzaA__ACO94511__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcuccaacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19081 - RNA, 1410 nt, Artificial Sequence; identical to SEQ ID NO: 18914
  derived and/or modified CDS sequence (AUadapt) from InfluenzaA__ACO94512__NA

SEQ ID NO: 19082 - RNA, 1410 nt, Artificial Sequence; identical to SEQ ID NO: 19001
  derived and/or modified CDS sequence (AUadapt) from InfluenzaA__ACO94513__NA

SEQ ID NO: 19083 - RNA, 1410 nt, Artificial Sequence
  derived and/or modified CDS sequence (AUadapt) from InfluenzaA__ACO94675__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaagaaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19084 - RNA, 1410 nt, Artificial Sequence
  derived and/or modified CDS sequence (AUadapt) from InfluenzaA__ACO94686__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggacauccugcgcacgcaggagucggagugcgucugcaucaacgggaccugcaccguggugaugaccgacggcuccgccagcggcaaggccgacacgaagauccucuucaucgaggagggcaagaucguccacaccucgacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggacgagcggcaccuacgggaccggcuccuggccggacggggccgagaucaaccugaugcccaucuga

SEQ ID NO: 19085 - RNA, 1410 nt, Artificial Sequence; identical to SEQ ID NO: 19001
  derived and/or modified CDS sequence (AUadapt) from InfluenzaA__ACO94697__NA

SEQ ID NO: 19086 - RNA, 1413 nt, Artificial Sequence; identical to SEQ ID NO: 19034
  derived and/or modified CDS sequence (AUadapt) from InfluenzaA__ACO94708__NA

SEQ ID NO: 19087 - RNA, 1410 nt, Artificial Sequence
  derived and/or modified CDS sequence (AUadapt) from InfluenzaA__ACO94719__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggacauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcgggcacugccucgaccccaacaacgaggagggcgggcacggcgugaaggggugggccuucgacgacggcaacgacgucuggaugggccgcaccaucuccgagaagucccggcugggguacgagaccuucaaggugaucgagggcuggucgaaccccaagagcaagcugcagaucaaccgccaggucaucguggaccgggggaaccgcuccggcuacucggggaucuucuccguggagggcaagagcugcaucaaccggugcuucuacgucgagcucauccgcggccggaaggaggagaccgaggugcuguggaccucgaacuccaucguggucuucugcgggaccagcggcacguacgggaccggcuccuggccggacggggccgagaucaaccugaugcccaucuga

SEQ ID NO: 19088 - RNA, 1410 nt, Artificial Sequence
  derived and/or modified CDS sequence (AUadapt) from InfluenzaA__ACO94741__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcaucguguccuggucgaaggagauccugcgcacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcagcugcuacccccgguaccccggcgugcgcugcgucugccgggacaacuggaagggguccaaccgccccaucguggacaucaacaucaaggaccacucgaucguguccagcuacgucugcuccggccuggugggcgacaccccgcggaagaacgacucguccagcuccucgcacugccucgaccccaacaacgaggagggcgggcacggggugaagggcugggccuucgacgacgggaacgacgucuggaugggccgcaccaucuccgagaagucccggcugggcuacgagacguucaaggugaucgagggguggagcaaccccaagagcaagcugcagaucaaccgccaggucaucguggaccggggcaaccgcuccggguacucgggcaucuucagcguggaguccaagucgugcaucaaccggugcuucuacgucgagcucauccgcgggcggaaggaggagaccgaggugcuguggaccuccaacagcaucguggucuucugcggcaccuccggcacguacgggaccggcagcuggcccgacggggccgacaucaaccugaugccgaucuga

SEQ ID NO: 19089 - RNA, 1410 nt, Artificial Sequence; identical to SEQ ID NO: 19005
  derived and/or modified CDS sequence (AUadapt) from InfluenzaA__ACO94763__NA

SEQ ID NO: 19090 - RNA, 1410 nt, Artificial Sequence
  derived and/or modified CDS sequence (AUadapt) from InfluenzaA__ACO94774__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcauggccuggagcuccucguccugccacgacgggcgggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19091 - RNA, 1410 nt, Artificial Sequence
  derived and/or modified CDS sequence (AUadapt) from InfluenzaA__ACO94785__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcaagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19092 - RNA, 1410 nt, Artificial Sequence; identical to SEQ ID NO: 19001
  derived and/or modified CDS sequence (AUadapt) from InfluenzaA__ACO94796__NA

SEQ ID NO: 19093 - RNA, 1413 nt, Artificial Sequence
  derived and/or modified CDS sequence (AUadapt) from InfluenzaA__ACO94807__NA
augaaccccaaccagaagaucaucaccaucggcucgaucuccaucgccaucgggaucaucagccugauccuccagaucggcaacaucaucuccaucugggccucgcacuccauccagaccgggagccagaaccacacgggcaucugcaaccagcgcaucaucaccuacgagaacuccaccugggugaacaacaccuacgucaacaucaacaacacgaacgugguggcggagaaggacaagaccucggucacccuggccgggaacuccagccugugcuccaucucgggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccucgccguacaacagccgcuucgaguccguggccuggagcgccuccgccugccacgacgggaugggcuggcucaccaucggcaucucggggcccgacaacggcgcgguggccguccugaaguacaacgggaucaucacggagaccaucaaguccuggaagaagcggauccugcgcacccaggagagcgagugcgugugcaugaacggcuccugcuucaccaucaugacggacggccccucgaacgggaccgccuccuacaagaucuucaagaucgagaagggcaaggugaccaagaccaucgagcucaacgcccccaacuuccacuacgaggagugcagcugcuacccggacacggggaccgucaugugcgugugccgggacaacuggcacggcuccaaccgccccugggugucguucaaccagaaccuggacuaccagaucggguacaucugcuccggcgucuucggcgacaacccccggcccaaggacggggagggcagcugcaacccggugaccguggacggggccgacggcgucaagggguucuccuacaaguacggcaacggcguguggaucgggcgcaccaagucgaaccggcugcgcaagggcuucgagaugaucugggaccccaacggguggacgaacaccgacuccgacuucagcgugaagcaggacgucguggcgaucaccgacugguccggcuacucggggagcuucgugcagcaccccgagcucaccggccuggacugcauccggcccugcuucugggucgagcuggugcgcggccucccgcgggagaacacgaccaucuggaccuccgggucguccaucagcuucugcggcgucaacuccgggaccgccaacuggagcuggcccgacggcgccgagcugcccuucacgaucgacaaguga

SEQ ID NO: 19094 - RNA, 1410 nt, Artificial Sequence; identical to SEQ ID NO: 18816
  derived and/or modified CDS sequence (AUadapt) from InfluenzaA__ACO94818__NA

SEQ ID NO: 19095 - RNA, 1365 nt, Artificial Sequence; identical to SEQ ID NO: 16322
  derived and/or modified CDS sequence (AUadapt) from InfluenzaA__ACO94829__NA

SEQ ID NO: 19096 - RNA, 1365 nt, Artificial Sequence; identical to SEQ ID NO: 16322
  derived and/or modified CDS sequence (AUadapt) from InfluenzaA__ACO94840__NA

SEQ ID NO: 19097 - RNA, 1410 nt, Artificial Sequence
  derived and/or modified CDS sequence (AUadapt) from InfluenzaA__ACO94851__NA
augaaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaucguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 19098 - RNA, 1413 nt, Artificial Sequence; identical to SEQ ID NO: 19034
  derived and/or modified CDS sequence (AUadapt) from InfluenzaA__ACO94873__NA

SEQ ID NO: 19099 - RNA, 1410 nt, Artificial Sequence
  derived and/or modified CDS sequence (AUadapt) from InfluenzaA__ACO94884__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaugugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 19100 - RNA, 1410 nt, Artificial Sequence; identical to SEQ ID NO: 17116
  derived and/or modified CDS sequence (AUadapt) from InfluenzaA__ACO94906__NA

SEQ ID NO: 19101 - RNA, 1410 nt, Artificial Sequence; identical to SEQ ID NO: 16547
  derived and/or modified CDS sequence (AUadapt) from InfluenzaA__ACO94917__NA

SEQ ID NO: 19102 - RNA, 1410 nt, Artificial Sequence; identical to SEQ ID NO: 17116
  derived and/or modified CDS sequence (AUadapt) from InfluenzaA__ACO94928__NA

SEQ ID NO: 19103 - RNA, 1410 nt, Artificial Sequence; identical to SEQ ID NO: 16547
  derived and/or modified CDS sequence (AUadapt) from InfluenzaA__ACO94939__NA

SEQ ID NO: 19104 - RNA, 1410 nt, Artificial Sequence
  derived and/or modified CDS sequence (AUadapt) from InfluenzaA__ACO94950__NA
augaaccccaaccagaagaucaucaccaucggcucggugucccugaccaucagcacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccucguccugccacgacgggaaggccuggcugcacgugugcgugaccggcgacgacaagaacgcgaccgccagcuucaucuacaacgggcgccugguggacuccaucgucucgugguccaagaagauccuccggacccaggagagcgagugcgugugcaucaacggcacgugcaccguggucaugaccgacggguccgccucgggcaaggccgacaccaagauccuguucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccucgugggcgacacgccccgcaagaacgacuccucguccagcucccacugccuggaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 19105 - RNA, 1410 nt, Artificial Sequence
  derived and/or modified CDS sequence (AUadapt) from InfluenzaA__ACO94961__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagcugugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacgacaccguccacgaccgcaccccguaccggacccuccugaugaacgagcugggcgugcccuuccaccucggcacgaagcaggucugcaucgccuggagcuccucguccugccacgacgggaaggccuggcugcacgugugcgugaccggcgacgacaagaacgcgaccgccagcuucaucuacaacgggcgccugguggacuccaucgucagcugguccaagaagauccuccggacccaggagucggagugcgugugcaucaacggcacgugcaccguggucaugaccgacggguccgccagcggcaaggccgacaccaagauccuguucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccucgugggcgacacgccccgcaagaacgacuccagcuccagcucccacugccuggaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcuccagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcuguggaccuccaacagcaucgucguguucugcggcaccuccgggacguacggcaccgggagcuggccggacggcgccgacaucaaccucaugcccaucuga

SEQ ID NO: 19106 - RNA, 1410 nt, Artificial Sequence
  derived and/or modified CDS sequence (AUadapt) from InfluenzaA__ACO94972__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacgagaacgcgaccgccagcuucaucuacaacgggcgccugguggacuccgucgugagcugguccaagaagauccugcggacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccgccaggugaucgucgaccggggcaaccggucgggguacuccggcaucuucagcguggagggcaagucgugcaucaaccgcugcuucuacguggagcucauccgggggcgcaaccaggagaccgagguccuguggaccuccaacagcaucgugguguucugcggcaccuccgggacguacggcaccgggagcuggccggacggcgccgacaucaaccugaugcccaucuga

SEQ ID NO: 19107 - RNA, 1410 nt, Artificial Sequence
  derived and/or modified CDS sequence (AUadapt) from InfluenzaA__ACO95156__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaccugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaagaagauccugcggacgcaggagagcgagugcgugugcaucaacgggaccugcaccguggucaugaccgacggguccgccucgggcaaggccgacacgaagauccucuucaucgaggagggcaagaucgugcacaccagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcggccacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcacguccgggaccuacggcaccgggagcuggccggacggcgccgacaucaaccugaugcccaucuga

SEQ ID NO: 19108 - RNA, 1410 nt, Artificial Sequence; identical to SEQ ID NO: 16729
  derived and/or modified CDS sequence (AUadapt) from InfluenzaA__ACO95174__NA

SEQ ID NO: 19109 - RNA, 1410 nt, Artificial Sequence; identical to SEQ ID NO: 16729
  derived and/or modified CDS sequence (AUadapt) from InfluenzaA__ACO95185__NA

SEQ ID NO: 19110 - RNA, 1410 nt, Artificial Sequence
  derived and/or modified CDS sequence (AUadapt) from InfluenzaA__ACO95196__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccauccacgaccgcaccccguaccggacccugcucaugaacgagcugggcguccccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccguggucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 19111 - RNA, 1410 nt, Artificial Sequence; identical to SEQ ID NO: 16729
  derived and/or modified CDS sequence (AUadapt) from InfluenzaA__ACO95207__NA

SEQ ID NO: 19112 - RNA, 1410 nt, Artificial Sequence; identical to SEQ ID NO: 16729
  derived and/or modified CDS sequence (AUadapt) from InfluenzaA__ACO95218__NA

SEQ ID NO: 19113 - RNA, 1410 nt, Artificial Sequence; identical to SEQ ID NO: 16732
  derived and/or modified CDS sequence (AUadapt) from InfluenzaA__ACO95229__NA

SEQ ID NO: 19114 - RNA, 1410 nt, Artificial Sequence; identical to SEQ ID NO: 17114
  derived and/or modified CDS sequence (AUadapt) from InfluenzaA__ACO95240__NA

SEQ ID NO: 19115 - RNA, 1410 nt, Artificial Sequence; identical to SEQ ID NO: 16975
  derived and/or modified CDS sequence (AUadapt) from InfluenzaA__ACO95262__NA

SEQ ID NO: 19116 - RNA, 1410 nt, Artificial Sequence; identical to SEQ ID NO: 18913
  derived and/or modified CDS sequence (AUadapt) from InfluenzaA__ACO95273__NA

SEQ ID NO: 19117 - RNA, 1410 nt, Artificial Sequence; identical to SEQ ID NO: 19005
  derived and/or modified CDS sequence (AUadapt) from InfluenzaA__ACO95306__NA

SEQ ID NO: 19118 - RNA, 1413 nt, Artificial Sequence
  derived and/or modified CDS sequence (AUadapt) from InfluenzaA__ACO95385__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucggacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 19119 - RNA, 1413 nt, Artificial Sequence; identical to SEQ ID NO: 19034
  derived and/or modified CDS sequence (AUadapt) from InfluenzaA__ACO95407__NA

SEQ ID NO: 19120 - RNA, 1413 nt, Artificial Sequence; identical to SEQ ID NO: 19034
  derived and/or modified CDS sequence (AUadapt) from InfluenzaA__ACO95418__NA

SEQ ID NO: 19121 - RNA, 1410 nt, Artificial Sequence; identical to SEQ ID NO: 16547
  derived and/or modified CDS sequence (AUadapt) from InfluenzaA__ACO95429__NA

SEQ ID NO: 19122 - RNA, 1410 nt, Artificial Sequence; identical to SEQ ID NO: 17116
  derived and/or modified CDS sequence (AUadapt) from InfluenzaA__ACO95440__NA

SEQ ID NO: 19123 - RNA, 1410 nt, Artificial Sequence
  derived and/or modified CDS sequence (AUadapt) from InfluenzaA__ACO95462__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcucaucuga

SEQ ID NO: 19124 - RNA, 1410 nt, Artificial Sequence; identical to SEQ ID NO: 17114
  derived and/or modified CDS sequence (AUadapt) from InfluenzaA__ACO95484__NA

SEQ ID NO: 19125 - RNA, 1410 nt, Artificial Sequence; identical to SEQ ID NO: 17114
  derived and/or modified CDS sequence (AUadapt) from InfluenzaA__ACO95495__NA

SEQ ID NO: 19126 - RNA, 1410 nt, Artificial Sequence; identical to SEQ ID NO: 17114
  derived and/or modified CDS sequence (AUadapt) from InfluenzaA__ACO95506__NA

SEQ ID NO: 19127 - RNA, 1410 nt, Artificial Sequence
  derived and/or modified CDS sequence (AUadapt) from InfluenzaA__ACO95517__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 19128 - RNA, 1410 nt, Artificial Sequence
  derived and/or modified CDS sequence (AUadapt) from InfluenzaA__ACO95539__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccaacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19129 - RNA, 1413 nt, Artificial Sequence
  derived and/or modified CDS sequence (AUadapt) from InfluenzaA__ACP20223__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccgugaccgacuggagcggcuacagcggguccuucguccagcaccccgagcucacgggccuggacugcauccggcccugcuucuggguggagcugguccgcggccucccgcgggagaacaccaccaucuggaccucgggguccagcaucuccuucugcggcgugaacagcgacacggccaacugguccuggcccgacggggccgagcugcccuucaccaucgacaaguga

SEQ ID NO: 19130 - RNA, 1410 nt, Artificial Sequence; identical to SEQ ID NO: 16274
  derived and/or modified CDS sequence (AUadapt) from InfluenzaA__ACP41952__NA

SEQ ID NO: 19131 - RNA, 1410 nt, Artificial Sequence; identical to SEQ ID NO: 16274
  derived and/or modified CDS sequence (AUadapt) from InfluenzaA__ACP44158__NA

SEQ ID NO: 19132 - RNA, 1413 nt, Artificial Sequence
  derived and/or modified CDS sequence (AUadapt) from InfluenzaA__ACP44195__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucggacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccugaacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 19133 - RNA, 1413 nt, Artificial Sequence; identical to SEQ ID NO: 19034
  derived and/or modified CDS sequence (AUadapt) from InfluenzaA__ACP44217__NA

SEQ ID NO: 19134 - RNA, 1413 nt, Artificial Sequence; identical to SEQ ID NO: 19034
  derived and/or modified CDS sequence (AUadapt) from InfluenzaA__ACP44228__NA

SEQ ID NO: 19135 - RNA, 1410 nt, Artificial Sequence; identical to SEQ ID NO: 17116
  derived and/or modified CDS sequence (AUadapt) from InfluenzaA__ACP44239__NA

SEQ ID NO: 19136 - RNA, 1410 nt, Artificial Sequence
  derived and/or modified CDS sequence (AUadapt) from InfluenzaA__ACP44250__NA
augaaccccaaccagaagaucaucaccaucggcucggugucccugaccaucagcacgaucugcuucuucaugcagaucgccauccucaugaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19137 - RNA, 1410 nt, Artificial Sequence
  derived and/or modified CDS sequence (AUadapt) from InfluenzaA__ACP44261__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacaugcacuccaacgacaccgugcacgaccgcaccccguaccggacccugcucaugaacgagcugggcguccccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgugagcugguccaaggagauccugcggacccaggagucggagugcgucugcaucaacggcacgugcaccguggugaugaccgacggguccgccagcggcaaggccgacaccaagauccucuucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 19138 - RNA, 1410 nt, Artificial Sequence
  derived and/or modified CDS sequence (AUadapt) from InfluenzaA__ACP44272__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccgugaucaugaccgacggguccgccagcggcaaggccgacaccaagauccucuucaucgaggagggcaagaucguccacacgucgacccuguccgggagcgcgcagcacguggaggagugcuccugcuacccccgcuaccccggcgugcggugcgucugccgcgacaacuggaaggggucgaaccggccgaucguggacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 19139 - RNA, 1410 nt, Artificial Sequence; identical to SEQ ID NO: 16274
  derived and/or modified CDS sequence (AUadapt) from InfluenzaA__ACQ55360__NA

SEQ ID NO: 19140 - RNA, 1410 nt, Artificial Sequence; identical to SEQ ID NO: 16318
  derived and/or modified CDS sequence (AUadapt) from InfluenzaA__ACQ63236__NA

SEQ ID NO: 19141 - RNA, 1410 nt, Artificial Sequence; identical to SEQ ID NO: 16318
  derived and/or modified CDS sequence (AUadapt) from InfluenzaA__ACQ63242__NA

SEQ ID NO: 19142 - RNA, 1410 nt, Artificial Sequence; identical to SEQ ID NO: 16318
  derived and/or modified CDS sequence (AUadapt) from InfluenzaA__ACQ63253__NA

SEQ ID NO: 19143 - RNA, 1410 nt, Artificial Sequence; identical to SEQ ID NO: 16318
  derived and/or modified CDS sequence (AUadapt) from InfluenzaA__ACQ63262__NA

SEQ ID NO: 19144 - RNA, 1410 nt, Artificial Sequence
  derived and/or modified CDS sequence (AUadapt) from InfluenzaA__ACQ65694__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggacauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggucgaaccggccgaucguggacaucaacaugaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 19145 - RNA, 1410 nt, Artificial Sequence
  derived and/or modified CDS sequence (AUadapt) from InfluenzaA__ACQ65705__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggcgcgggucgaaccggccgaucguggacaucaacaugaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 19146 - RNA, 1410 nt, Artificial Sequence; identical to SEQ ID NO: 18914
  derived and/or modified CDS sequence (AUadapt) from InfluenzaA__ACQ65716__NA

SEQ ID NO: 19147 - RNA, 1410 nt, Artificial Sequence; identical to SEQ ID NO: 18914
  derived and/or modified CDS sequence (AUadapt) from InfluenzaA__ACQ65727__NA

SEQ ID NO: 19148 - RNA, 1410 nt, Artificial Sequence; identical to SEQ ID NO: 19001
  derived and/or modified CDS sequence (AUadapt) from InfluenzaA__ACQ65739__NA

SEQ ID NO: 19149 - RNA, 1410 nt, Artificial Sequence
  derived and/or modified CDS sequence (AUadapt) from InfluenzaA__ACQ65750__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcaaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 19150 - RNA, 1413 nt, Artificial Sequence; identical to SEQ ID NO: 19034
  derived and/or modified CDS sequence (AUadapt) from InfluenzaA__ACQ65761__NA

SEQ ID NO: 19151 - RNA, 1410 nt, Artificial Sequence; identical to SEQ ID NO: 16274
  derived and/or modified CDS sequence (AUadapt) from InfluenzaA__ACQ73394__NA

SEQ ID NO: 19152 - RNA, 1410 nt, Artificial Sequence; identical to SEQ ID NO: 16274
  derived and/or modified CDS sequence (AUadapt) from InfluenzaA__ACQ73395__NA

SEQ ID NO: 19153 - RNA, 1410 nt, Artificial Sequence; identical to SEQ ID NO: 16318
  derived and/or modified CDS sequence (AUadapt) from InfluenzaA__ACQ73396__NA

SEQ ID NO: 19154 - RNA, 1410 nt, Artificial Sequence; identical to SEQ ID NO: 16318
  derived and/or modified CDS sequence (AUadapt) from InfluenzaA__ACQ76291__NA

SEQ ID NO: 19155 - RNA, 1410 nt, Artificial Sequence
  derived and/or modified CDS sequence (AUadapt) from InfluenzaA__ACQ76298__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccaucaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19156 - RNA, 1410 nt, Artificial Sequence; identical to SEQ ID NO: 16318
  derived and/or modified CDS sequence (AUadapt) from InfluenzaA__ACQ76308__NA

SEQ ID NO: 19157 - RNA, 1410 nt, Artificial Sequence; identical to SEQ ID NO: 16318
  derived and/or modified CDS sequence (AUadapt) from InfluenzaA__ACQ76316__NA

SEQ ID NO: 19158 - RNA, 1410 nt, Artificial Sequence; identical to SEQ ID NO: 16274
  derived and/or modified CDS sequence (AUadapt) from InfluenzaA__ACQ76322__NA

SEQ ID NO: 19159 - RNA, 1410 nt, Artificial Sequence; identical to SEQ ID NO: 16274
  derived and/or modified CDS sequence (AUadapt) from InfluenzaA__ACQ76328__NA

SEQ ID NO: 19160 - RNA, 1410 nt, Artificial Sequence; identical to SEQ ID NO: 16274
  derived and/or modified CDS sequence (AUadapt) from InfluenzaA__ACQ76335__NA

SEQ ID NO: 19161 - RNA, 1410 nt, Artificial Sequence; identical to SEQ ID NO: 16274
  derived and/or modified CDS sequence (AUadapt) from InfluenzaA__ACQ76342__NA

SEQ ID NO: 19162 - RNA, 1410 nt, Artificial Sequence; identical to SEQ ID NO: 16274
  derived and/or modified CDS sequence (AUadapt) from InfluenzaA__ACQ76351__NA

SEQ ID NO: 19163 - RNA, 1410 nt, Artificial Sequence; identical to SEQ ID NO: 16274
  derived and/or modified CDS sequence (AUadapt) from InfluenzaA__ACQ76359__NA

SEQ ID NO: 19164 - RNA, 1410 nt, Artificial Sequence; identical to SEQ ID NO: 16318
  derived and/or modified CDS sequence (AUadapt) from InfluenzaA__ACQ76364__NA

SEQ ID NO: 19165 - RNA, 1410 nt, Artificial Sequence; identical to SEQ ID NO: 16318
  derived and/or modified CDS sequence (AUadapt) from InfluenzaA__ACQ76367__NA

SEQ ID NO: 19166 - RNA, 1410 nt, Artificial Sequence
  derived and/or modified CDS sequence (AUadapt) from InfluenzaA__ACQ76379__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacaagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 19167 - RNA, 1410 nt, Artificial Sequence; identical to SEQ ID NO: 16318
  derived and/or modified CDS sequence (AUadapt) from InfluenzaA__ACQ76385__NA

SEQ ID NO: 19168 - RNA, 1410 nt, Artificial Sequence; identical to SEQ ID NO: 16318
  derived and/or modified CDS sequence (AUadapt) from InfluenzaA__ACQ76388__NA

SEQ ID NO: 19169 - RNA, 1410 nt, Artificial Sequence; identical to SEQ ID NO: 16318
  derived and/or modified CDS sequence (AUadapt) from InfluenzaA__ACQ76403__NA

SEQ ID NO: 19170 - RNA, 1410 nt, Artificial Sequence
  derived and/or modified CDS sequence (AUadapt) from InfluenzaA__ACQ76407__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucggcggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacucccgguucgagagcguggccuggagcgcguccgccugccacgacggcaucaacuggcucaccaucggcaucucggggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 19171 - RNA, 1410 nt, Artificial Sequence
  derived and/or modified CDS sequence (AUadapt) from InfluenzaA__ACQ77603__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgaagcaggucugcaucgccugguccagcuccucgugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgucgccccugagcggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacucguccagcuccucgcacugccuggaccccaacaacgaggagggcgggcacggggucaagggcugggccuucgacgacggcaacgacguguggauggggcggaccaucuccgagaagucccgcucgggcuacgagaccuucaaggucaucgagggguggagcaagccgaacuccaagcugcagaucaaccgccaggugaucguggaccggggcaaccggucgggguacuccggcaucuucucggucgagggcaagagcugcaucaaccgcugcuucuacguggagcucauccgggggcgcaagcaggagaccgaggugcuguggaccuccaacucgaucgucguguucugcggcaccuccgggaccuacggcacggggagcuggcccgacggcgccgacaucaaccugaugcccaucuga

SEQ ID NO: 19172 - RNA, 1410 nt, Artificial Sequence; identical to SEQ ID NO: 16274
  derived and/or modified CDS sequence (AUadapt) from InfluenzaA__ACQ83309__NA

SEQ ID NO: 19173 - RNA, 1410 nt, Artificial Sequence; identical to SEQ ID NO: 16274
  derived and/or modified CDS sequence (AUadapt) from InfluenzaA__ACQ84460__NA

SEQ ID NO: 19174 - RNA, 1410 nt, Artificial Sequence; identical to SEQ ID NO: 16274
  derived and/or modified CDS sequence (AUadapt) from InfluenzaA__ACQ84470__NA

SEQ ID NO: 19175 - RNA, 1410 nt, Artificial Sequence
  derived and/or modified CDS sequence (AUadapt) from InfluenzaA__ACQ84480__NA
augaacaccaaccagcgcaucaucaccaucggcacggugugccugaucgucgggaucgugucgcuccugcugcagaucggcaacaucgugucccucuggaucagccacuccaucaagaccggggagaagaaccacagcgagaucugcaaccagaacaucaucaccuacgagaacaagaccugggucaaccagacguacgugaacaucuccaacaccaacaucgccgacggccagggggugaccagcaucauccuggccggcaacuccucgcugugccccaucuccggcugggcgaucuacagcaaggacaacuccauccggaucgggagcaagggcgacaucuucgucauccgcgagccguucaucuccugcagccaccucgagugccggaccuucuuccugacgcagggggcccugcucaacgaccgccacuccaacggcaccgugaaggaccggagccccuaccgcacccugauguccugccccaccggggaggcccccucgccguacaacucccgguucgagagcguggccuggagcgccuccgcgugccacgacggcaugggcuggcugacgaucgggaucagcggccccgacaacggggccgucgccgugcucaaguacaacggcaucaucaccgacaccaucaaguccuggcgcaacaagauccugcggacccaggagagcgagugcgugugcaucaacggcuccugcuucacgaucaugaccgacgggcccucgaacggccaggccuccuacaagaucuucaagauggagaaggggaagaucaucaagagcgucgagcuggacgcgcccaacuaccacuacgaggagugcuccugcuacccggacaccggcaagguggugugcgucugccgcgacaacuggcacgccagcaaccggcccuggguguccuucgaccagaaccucgacuaccagaucggguacaucugcagcggcguguucggcgacaacccccgcuccaacgacgggaagggcaacugcgggcccguccugagcaacggcgccaacggggugaagggcuucuccuuccgguacggcaacgggguguggaucggccgcaccaagucgaucuccagccgguccggguucgagaugaucugggacccgaacggcuggacggagaccgacagcagcuucuccaucaagcaggacaucaucgcccugaccgacuggagcggguacuccggcucguucguccagcaccccgagcucaccggcaugaacugcauccgccccugcuucuggguggagcugauccgggggcagcccaaggaguccacgaucuggaccagcggcuccagcaucuccuucugcgggguggacagcgagaccgccuccuggagcuggccggacggcgcggaccugcccuucaccaucgacaaguga

SEQ ID NO: 19176 - RNA, 1410 nt, Artificial Sequence
  derived and/or modified CDS sequence (AUadapt) from InfluenzaA__ACQ89891__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugccggggcaucuucggggacaacccgcgccccaacgacaagaccggcuccugcggccccgugagcuccaacggggccaacggcgugaagggguucucguucaaguacggcaacggggucuggaucggccggaccaaguccaucagcagccgcaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 19177 - RNA, 1410 nt, Artificial Sequence; identical to SEQ ID NO: 16274
  derived and/or modified CDS sequence (AUadapt) from InfluenzaA__ACQ89918__NA

SEQ ID NO: 19178 - RNA, 1410 nt, Artificial Sequence
  derived and/or modified CDS sequence (AUadapt) from InfluenzaA__ACQ89919__NA
augaaccccaaccagaagaucaucaccaucggcucggugugcaugaccaucgggauggccaaccugauccuccagaucggcaacaucaucuccaucuggaucagccgcuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcggaucggcuccaagggggacguguucgucauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggucgugcuucaccgucaugaccgacggcccguccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugucguucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 19179 - RNA, 1410 nt, Artificial Sequence; identical to SEQ ID NO: 16318
  derived and/or modified CDS sequence (AUadapt) from InfluenzaA__ACQ89920__NA

SEQ ID NO: 19180 - RNA, 1410 nt, Artificial Sequence; identical to SEQ ID NO: 16318
  derived and/or modified CDS sequence (AUadapt) from InfluenzaA__ACQ89921__NA

SEQ ID NO: 19181 - RNA, 1410 nt, Artificial Sequence; identical to SEQ ID NO: 16274
  derived and/or modified CDS sequence (AUadapt) from InfluenzaA__ACQ89922__NA

SEQ ID NO: 19182 - RNA, 1410 nt, Artificial Sequence; identical to SEQ ID NO: 16318
  derived and/or modified CDS sequence (AUadapt) from InfluenzaA__ACQ89923__NA

SEQ ID NO: 19183 - RNA, 1410 nt, Artificial Sequence; identical to SEQ ID NO: 16274
  derived and/or modified CDS sequence (AUadapt) from InfluenzaA__ACQ99623__NA

SEQ ID NO: 19184 - RNA, 1410 nt, Artificial Sequence; identical to SEQ ID NO: 16318
  derived and/or modified CDS sequence (AUadapt) from InfluenzaA__ACQ99624__NA

SEQ ID NO: 19185 - RNA, 1410 nt, Artificial Sequence; identical to SEQ ID NO: 16274
  derived and/or modified CDS sequence (AUadapt) from InfluenzaA__ACQ99626__NA

SEQ ID NO: 19186 - RNA, 1410 nt, Artificial Sequence; identical to SEQ ID NO: 16274
  derived and/or modified CDS sequence (AUadapt) from InfluenzaA__ACQ99627__NA

SEQ ID NO: 19187 - RNA, 1410 nt, Artificial Sequence; identical to SEQ ID NO: 16274
  derived and/or modified CDS sequence (AUadapt) from InfluenzaA__ACQ99628__NA

SEQ ID NO: 19188 - RNA, 1410 nt, Artificial Sequence; identical to SEQ ID NO: 16274
  derived and/or modified CDS sequence (AUadapt) from InfluenzaA__ACQ99629__NA

SEQ ID NO: 19189 - RNA, 1410 nt, Artificial Sequence; identical to SEQ ID NO: 16274
  derived and/or modified CDS sequence (AUadapt) from InfluenzaA__ACQ99630__NA

SEQ ID NO: 19190 - RNA, 1410 nt, Artificial Sequence; identical to SEQ ID NO: 16318
  derived and/or modified CDS sequence (AUadapt) from InfluenzaA__ACQ99632__NA

SEQ ID NO: 19191 - RNA, 1410 nt, Artificial Sequence; identical to SEQ ID NO: 16318
  derived and/or modified CDS sequence (AUadapt) from InfluenzaA__ACQ99633__NA

SEQ ID NO: 19192 - RNA, 1410 nt, Artificial Sequence; identical to SEQ ID NO: 16274
  derived and/or modified CDS sequence (AUadapt) from InfluenzaA__ACQ99635__NA

SEQ ID NO: 19193 - RNA, 1410 nt, Artificial Sequence; identical to SEQ ID NO: 16274
  derived and/or modified CDS sequence (AUadapt) from InfluenzaA__ACQ99636__NA

SEQ ID NO: 19194 - RNA, 1410 nt, Artificial Sequence
  derived and/or modified CDS sequence (AUadapt) from InfluenzaA__ACQ99684__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacgagcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 19195 - RNA, 1410 nt, Artificial Sequence
  derived and/or modified CDS sequence (AUadapt) from InfluenzaA__ACQ99824__NA
augaacaccaaccagcgcaucaucaccaucggcacgaucugccugaucguggggaucaucucgcuccugcugcagaucggcaacaucauccuccuguggaugucccacagcauccagaccggggagaagucccaccccaaggucugcaaccagagcgugaucaccuacgagaacaacaccugggugaaccagacguacgucaacaucuccaacaccaacaucgccgccggccagggggugaccccgaucauccuggcgggcaacagcucccucugccccaucagcggcugggccaucuacuccaaggacaacagcauccggaucggguccaagggcgacaucuucgugaugcgcgagcccuucaucagcugcucccaccuggagugccggaccuucuuccugacgcagggggcccuccugaacgaccgccacucgaacggcaccgucaaggaccggucccccuaccgcacccugaugagcugcccgaucggggaggcccccucccccuacaacagccgguucgaguccguggccuggagcgcgagcgccugccacgacggcaugggcuggcucaccaucgggaucuccggccccgacaacggggccguggccguccugaaguacaacggcaucaucacggacaccaucaagagcuggcgcaacaagauccugcggacccaggaguccgagugcgugugcaucaacggcagcugcuucaccaucaugacggacgggccguccaacggccaggcgucguacaagcuguucaagauggagaaggggaagaucaucaaguccaucgagcucgacgcccccaacuaccacuacgaggagugcagcugcuaccccgacaccggcaagguggucugcgugugccgcgacaacuggcacgccuccaaccggcccugggugagcuucgaccagaaccuggacuaccagaucggguacaucugcuccggcgucuucggcgacaacccgcgcagcaacgacgggaagggcaacugcgggcccgugcucuccaacggcgccaacggggugaagggcuucagcuuccgguacggcaacggggucuggaucggccgcaccaaguccaucagcucccggagcggguucgagaugaucugggaccccaacggcuggaccgagacggacuccucguucagcaugaagcaggacaucaucgcccugaccgacugguccggguacagcggcuccuucgugcagcaccccgagcugaccggcaugaacugcauccgcccgugcuucuggguggagcucauccgggggcagcccaaggagagcaccaucuggacguccggcagcuccaucagcuucugcggggucaacuccggcaccgcgagcugguccuggcccgacggcgccgaccugcccuucaccaucgacaaguga

SEQ ID NO: 19196 - RNA, 1410 nt, Artificial Sequence; identical to SEQ ID NO: 16318
  derived and/or modified CDS sequence (AUadapt) from InfluenzaA__ACR01015__NA

SEQ ID NO: 19197 - RNA, 1410 nt, Artificial Sequence; identical to SEQ ID NO: 16318
  derived and/or modified CDS sequence (AUadapt) from InfluenzaA__ACR08422__NA

SEQ ID NO: 19198 - RNA, 1410 nt, Artificial Sequence; identical to SEQ ID NO: 16318
  derived and/or modified CDS sequence (AUadapt) from InfluenzaA__ACR08432__NA

SEQ ID NO: 19199 - RNA, 1410 nt, Artificial Sequence; identical to SEQ ID NO: 16318
  derived and/or modified CDS sequence (AUadapt) from InfluenzaA__ACR08442__NA

SEQ ID NO: 19200 - RNA, 1410 nt, Artificial Sequence; identical to SEQ ID NO: 16318
  derived and/or modified CDS sequence (AUadapt) from InfluenzaA__ACR08452__NA

SEQ ID NO: 19201 - RNA, 1410 nt, Artificial Sequence
  derived and/or modified CDS sequence (AUadapt) from InfluenzaA__ACR08462__NA
augucgcccaaccagaagaucaucaccaucggcuccgugugcaugaccaucgggauggccaaccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagucggagugcgcgugcgugaacggguccugcuucaccgucaugaccgacggcccgagcaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 19202 - RNA, 1410 nt, Artificial Sequence
  derived and/or modified CDS sequence (AUadapt) from InfluenzaA__ACR08565__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccucgcucugccccgucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgaggugcccagccccuacaacucccgguucgagagcguggccuggagcgcguccgccugccacgacgggaucaacuggcucaccaucggcaucucgggcccggacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggccccagcaacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccguggguguccuucaaccagaaccucgaguaccagaucggguacaucugcagcggcaucuucggggacaacccccggcccaacgacaagaccggcuccugcggccccgugagcuccaacggggccaacggcgucaagggguucucguucaaguacggcaacgggguguggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucguccagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgccgagcugcccuucacgaucgacaaguga

SEQ ID NO: 19203 - RNA, 1410 nt, Artificial Sequence; identical to SEQ ID NO: 16274
  derived and/or modified CDS sequence (AUadapt) from InfluenzaA__ACR08566__NA

SEQ ID NO: 19204 - RNA, 1410 nt, Artificial Sequence; identical to SEQ ID NO: 16318
  derived and/or modified CDS sequence (AUadapt) from InfluenzaA__ACR08567__NA

SEQ ID NO: 19205 - RNA, 1410 nt, Artificial Sequence; identical to SEQ ID NO: 16274
  derived and/or modified CDS sequence (AUadapt) from InfluenzaA__ACR08568__NA

SEQ ID NO: 19206 - RNA, 1410 nt, Artificial Sequence; identical to SEQ ID NO: 16274
  derived and/or modified CDS sequence (AUadapt) from InfluenzaA__ACR08569__NA

SEQ ID NO: 19207 - RNA, 1410 nt, Artificial Sequence; identical to SEQ ID NO: 16318
  derived and/or modified CDS sequence (AUadapt) from InfluenzaA__ACR08570__NA

SEQ ID NO: 19208 - RNA, 1410 nt, Artificial Sequence; identical to SEQ ID NO: 16274
  derived and/or modified CDS sequence (AUadapt) from InfluenzaA__ACR08571__NA

SEQ ID NO: 19209 - RNA, 1410 nt, Artificial Sequence; identical to SEQ ID NO: 16274
  derived and/or modified CDS sequence (AUadapt) from InfluenzaA__ACR08572__NA

SEQ ID NO: 19210 - RNA, 1410 nt, Artificial Sequence; identical to SEQ ID NO: 16274
  derived and/or modified CDS sequence (AUadapt) from InfluenzaA__ACR08573__NA

SEQ ID NO: 19211 - RNA, 1410 nt, Artificial Sequence; identical to SEQ ID NO: 16274
  derived and/or modified CDS sequence (AUadapt) from InfluenzaA__ACR08574__NA

SEQ ID NO: 19212 - RNA, 1410 nt, Artificial Sequence; identical to SEQ ID NO: 16318
  derived and/or modified CDS sequence (AUadapt) from InfluenzaA__ACR08576__NA

SEQ ID NO: 19213 - RNA, 1410 nt, Artificial Sequence; identical to SEQ ID NO: 16274
  derived and/or modified CDS sequence (AUadapt) from InfluenzaA__ACR08577__NA

SEQ ID NO: 19214 - RNA, 1410 nt, Artificial Sequence; identical to SEQ ID NO: 16274
  derived and/or modified CDS sequence (AUadapt) from InfluenzaA__ACR09378__NA

SEQ ID NO: 19215 - RNA, 1410 nt, Artificial Sequence; identical to SEQ ID NO: 16274
  derived and/or modified CDS sequence (AUadapt) from InfluenzaA__ACR09379__NA

SEQ ID NO: 19216 - RNA, 1410 nt, Artificial Sequence; identical to SEQ ID NO: 16318
  derived and/or modified CDS sequence (AUadapt) from InfluenzaA__ACR09380__NA

SEQ ID NO: 19217 - RNA, 1410 nt, Artificial Sequence; identical to SEQ ID NO: 16274
  derived and/or modified CDS sequence (AUadapt) from InfluenzaA__ACR09381__NA

SEQ ID NO: 19218 - RNA, 1410 nt, Artificial Sequence; identical to SEQ ID NO: 16274
  derived and/or modified CDS sequence (AUadapt) from InfluenzaA__ACR09382__NA

SEQ ID NO: 19219 - RNA, 1410 nt, Artificial Sequence; identical to SEQ ID NO: 16318
  derived and/or modified CDS sequence (AUadapt) from InfluenzaA__ACR09383__NA

SEQ ID NO: 19220 - RNA, 1410 nt, Artificial Sequence; identical to SEQ ID NO: 16274
  derived and/or modified CDS sequence (AUadapt) from InfluenzaA__ACR09384__NA

SEQ ID NO: 19221 - RNA, 1410 nt, Artificial Sequence; identical to SEQ ID NO: 16318
  derived and/or modified CDS sequence (AUadapt) from InfluenzaA__ACR09385__NA

SEQ ID NO: 19222 - RNA, 1410 nt, Artificial Sequence; identical to SEQ ID NO: 16274
  derived and/or modified CDS sequence (AUadapt) from InfluenzaA__ACR09386__NA

SEQ ID NO: 19223 - RNA, 1410 nt, Artificial Sequence; identical to SEQ ID NO: 16318
  derived and/or modified CDS sequence (AUadapt) from InfluenzaA__ACR10189__NA

SEQ ID NO: 19224 - RNA, 1410 nt, Artificial Sequence; identical to SEQ ID NO: 16318
  derived and/or modified CDS sequence (AUadapt) from InfluenzaA__ACR10226__NA

SEQ ID NO: 19225 - RNA, 1410 nt, Artificial Sequence; identical to SEQ ID NO: 16274
  derived and/or modified CDS sequence (AUadapt) from InfluenzaA__ACR10236__NA

SEQ ID NO: 19226 - RNA, 1410 nt, Artificial Sequence; identical to SEQ ID NO: 16274
  derived and/or modified CDS sequence (AUadapt) from InfluenzaA__ACR10237__NA

SEQ ID NO: 19227 - RNA, 1410 nt, Artificial Sequence
  derived and/or modified CDS sequence (AUadapt) from InfluenzaA__ACR15186__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaaguggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccggcaccccggcguccgcugcgugugccgggacaacuggcgcgggagcaaccggccgaucguggacaucaacaugaaggacuacuccaucgucucguccuacgugugcagcggccuggugggcgacacgccccgcaagaacgacuccucguccagcgggcacugccucgaccccaacaacgaggagggcgggcacggcgucaaggggugggccuucgacgacggcaacgacguguggaugggccggaccaucuccgagaagcugcgcucgggguacgagaccuucaaggucaucgagggcugguccaaccccaacagcaagcugcagaucaaccgccaggugaucguggaccgggggaaccgguccggcuacucggggaucuucuccgucgagggcaagagcugcaucaaccgcugcuucuacguggagcucauccggggccgcaaggaggagaccgaggugcuguggaccucgaacuccaucgucguguucugcgggaccagcggcacguacgggaccggcuccuggccggacggggccgacaucaaccugaugcccaucuga

SEQ ID NO: 19228 - RNA, 1413 nt, Artificial Sequence; identical to SEQ ID NO: 19034
  derived and/or modified CDS sequence (AUadapt) from InfluenzaA__ACR15197__NA

SEQ ID NO: 19229 - RNA, 1410 nt, Artificial Sequence
  derived and/or modified CDS sequence (AUadapt) from InfluenzaA__ACR15208__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggacaagggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 19230 - RNA, 1410 nt, Artificial Sequence
  derived and/or modified CDS sequence (AUadapt) from InfluenzaA__ACR15230__NA
auggaccccaaccagaagaucaucaccaucggcucggugucccugaccaucagcgccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggucgaagccgcagugcaacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccacgaccgcaccccguaccggacccugcucaugaacgagcugggcgugcccuuccaccugggcaccaagcaggucugcaucgccuggagcuccucguccugccacgacgggaaggcguggcuccacgugugcgugacgggcgacgacgagaacgccaccgccagcuucaucuacaacgggcgccugguggacuccgucgugucgugguccaagaagauccugcggacccaggagagcgagugcgugugcaucaacgggaccugcacggucgugaugaccgacggguccgccucgggcaaggcggacaccaagauccucuucaucgaggagggcaagaucgugcacaccagcacgcuguccgggagcgcccagcacgucgaggagugcuccugcuacccccgcuaccccggcgugcggugcgugugccgcgacaacuggaaggggucgaaccggccgaucgucgacaucaacaucaaggacuacuccaucgugagcuccuacgugugcucgggccuggucggcgacacgccccgcaagaacgacuccagcuccaacucgcacugccucgaccccaacaacgaggagggcggccacggggugaagggcugggccuucgacgacgggaacgacgucuggaugggccggaccaucuccgagaagcugcgcagcggcuacgagaccuucaaggugaucgaggggugguccaaccccaacucgaagcugcagaucaaccgccaggugaucgucgaccggggcaaccgguccggguacagcggcaucuucuccguggagggcaagucgugcaucaaccgcugcuucuacguggagcucauccgggggcgcaaccaggagaccgagguccuguggaccagcaacuccaucgugguguucugcggcaccagcgggaccuacggcacgggguccuggccggacggcgccgacaucaaccugaugcccaucuga

SEQ ID NO: 19231 - RNA, 1413 nt, Artificial Sequence; identical to SEQ ID NO: 19034
  derived and/or modified CDS sequence (AUadapt) from InfluenzaA__ACR15241__NA

SEQ ID NO: 19232 - RNA, 1410 nt, Artificial Sequence; identical to SEQ ID NO: 18286
  derived and/or modified CDS sequence (AUadapt) from InfluenzaA__ACR15252__NA

SEQ ID NO: 19233 - RNA, 1413 nt, Artificial Sequence
  derived and/or modified CDS sequence (AUadapt) from InfluenzaA__ACR15263__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacagcgacuucuccgugaagcaggacgucguggccaucaccgacuggucgggcuacagcggguccuucgugcagcaccccgagcucacgggccuggacugcauccggcccugcuucugggucgagcuggugcgcggccucccgcgggagaacaccaccaucuggagcuccgggucguccaucagcuucugcggcgucaacuccgacaccgccaacuggagcuggcccgacggggccgagcugcccuucacgaucgacaaguga

SEQ ID NO: 19234 - RNA, 1413 nt, Artificial Sequence; identical to SEQ ID NO: 19034
  derived and/or modified CDS sequence (AUadapt) from InfluenzaA__ACR15274__NA

SEQ ID NO: 19235 - RNA, 1413 nt, Artificial Sequence
  derived and/or modified CDS sequence (AUadapt) from InfluenzaA__ACR15307__NA
augaaccccaaccagaagaucaucaccaucggcucgaucuccaucaccaucgggaucaucagccugaugcuccagaucggcaacaucaucuccaucugggccucgcacuccauccagacggggagccagaaccacaccggcaucugcaaccagcgcaucaucaccuacgagaacaacaccugggugaaccacacguacgucaacaucaacaacaccaacgugguggccgggaaggacaagaccuccgucacccuggcgggcaacucgucccugugcagcaucuccggcugggccaucuacacgaaggacaacucgauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcccccuccccguacaacucgaaguucgagagcguggcgugguccgccagcgccugccacgacggcaugggcuggcucacgaucgggaucuccggccccgacaacggggccguggcgguccugaaguacaacggcaucaucaccgagaccaucaagucguggaagaagcgcauccugcggacccaggaguccgagugcgugugcgugaacggcagcugcuucacgaucaugaccgacgggcccuccaacggcgccgccucguacaagaucuucaagaucgagaaggggaaggucaccaaguccaucgagcucaacgcccccaacuuccacuacgaggagugcagcugcuacccggacaccggcacggugaugugcgugugccgcgacaacuggcacggguccaaccggcccugggucucguucaaccagaaccuggacuaccagaucggcuacaucugcuccggcguguucggggacaacccccgccccaaggacggcgaggggagcugcaacccggugaccgucgacggcgccgacggggugaagggcuucuccuacaaguacggcaacgggguguggaucggccggaccaagucgaaccgccugcggaagggguucgagaugaucugggaccccaacggcuggaccgacacggacuccgacuucagcgucaagcaggacgugguggcgaucaccgacugguccggguacucgggcagcuucguccagcaccccgagcucaccggccuggacugcauccgccccugcuucuggguggagcugguccgggggcucccgcgcgagaacaccacgaucuggaccuccggcucguccaucagcuucugcggggugaacuccgacaccgccaacuggagcuggcccgacggcgccgagcugcccuucaccaucgacaaguga

SEQ ID NO: 19236 - RNA, 1413 nt, Artificial Sequence
  derived and/or modified CDS sequence (AUadapt) from InfluenzaA__ACR15318__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagcgccagauccugcggacccaggagucggagugcgugugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcgaacggggugaagggcuucagcuacaaguacggcaacgggguguggaucggccggaccaaguccaaccgccugcggaagggguucgagaugaucugggaccccaacggcuggaccgacaccgacagcgacuucuccgucaagcaggacgugguggccaucacggacuggucgggguacagcggcuccuucguccagcaccccgagcucaccggccuggacugcauccgccccugcuucuggguggagcugguccgggggcucccgaaggagaacaccaccaucuggacgucgggcuccagcaucuccuucugcggggugaacagcgacaccgccaacugguccuggcccgacggcgccgagcugcccuucaccaucgacaaguga

SEQ ID NO: 19237 - RNA, 1413 nt, Artificial Sequence
  derived and/or modified CDS sequence (AUadapt) from InfluenzaA__ACR15329__NA
augaaccccaaccagaagaucaucaccaucggcucgaucuccaucgccaucgggaucaucagccugaugcuccagaucggcaacaucaucuccaucugggccucgcacuccauccagacccgcagccagaaccacacgggggugugcaaccagcggaucaucaccuacgagaacuccaccugggucaaccacaccuacgugaacaucaacaacacgaacgugaucgcgggcaaggacaagaccucggucacccuggccgggaacuccagccugugcuccaucagcggcugggccaucuacaccaaggacaacuccauccgcaucggcucgaagggggacguguucgugauccgggagccguucaucuccugcagccaccucgagugccgcacguucuuccugacccagggcgcccugcucaacgacaagcacuccaacgggaccgucaaggaccggucgcccuaccgcgcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacggagaccaucaaguccuggaagaagcagauccugcggacccaggagucggagugcgugugcgugaacggcuccugcuucaccaucaugacggacggccccagcaacggggccgccuccuacaagaucuucaagaucgagaagggcaaggucaccaagucgaucgagcucaacgcccccaacuuccacuacgaggagugcuccugcuacccggacaccgggaccgugaugugcgugugccgcgacaacuggcacggcagcaaccggcccugggucuccuucaaccagaaccuggacuaccagaucggguacaucugcucgggcguguucggcgacaacccccgccccaaggacggggagggcuccugcaacccggugacggucgacggggcgaacggcgugaagggguucagcuacaaguacggcaacggcguguggaucgggcggaccaaguccaaccgccugcggaagggcuucgagaugaucugggaccccaacggguggaccgacaccgacagcgacuucuccgucaagcaggacgugguggccaucacggacuggucgggcuacagcggguccuucguccagcaccccgagcucaccggccuggacugcauccgccccugcuucuggguggagcugguccggggccucccgaaggagaacaccaccaucuggacgucgggguccagcaucuccuucugcggcgugaacagcgacaccgccaacugguccuggcccgacggggccgagcugcccuucaccaucgacaaguga

SEQ ID NO: 19238 - RNA, 1413 nt, Artificial Sequence; identical to SEQ ID NO: 19034
  derived and/or modified CDS sequence (AUadapt) from InfluenzaA__ACR15340__NA

SEQ ID NO: 19239 - RNA, 1413 nt, Artificial Sequence; identical to SEQ ID NO: 19034
  derived and/or modified CDS sequence (AUadapt) from InfluenzaA__ACR15362__NA

SEQ ID NO: 19240 - RNA, 1413 nt, Artificial Sequence; identical to SEQ ID NO: 19034
  derived and/or modified CDS sequence (AUadapt) from InfluenzaA__ACR15373__NA

SEQ ID NO: 19241 - RNA, 1413 nt, Artificial Sequence
  derived and/or modified CDS sequence (AUadapt) from InfluenzaA__ACR15428__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccgugagcggcugggccaucuacaccaaggacaacuccauccggaucgggucgaagggcgacguguucgucauccgcgagccguucaucuccugcagccaccucgagugccggacguucuuccugaccaagggggcccugcucaacgacaagcacuccaacggcaccgugaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcggucgccgugcugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggucaccaagagcaucgagcucaacgcccccaacuuccacuacgaggagugcuccugcuacccggacaccggcaucgugaugugcgugugccgggacaacuggcacgggagcaaccgccccugggucuccuucaaccagaaccuggacuaccagaucggcuacaucugcucgggcguguucggggacaacccccggcccgaggacggcgagggguccugcaacccggugaccgucgacggcgcgaacggggugaagggcuucagcuacaaguacgacaacggcguguggaucgggcgcacgaaguccaaccggcugcgcaagggcuucgagaugaucugggaccccaacggguggaccaacaccgacucggacuucuccgucaagcaggacgugguggccaucaccgacuggagcggcuacagcggguccuucguccagcaccccgagcucacgggccuggacugcauccggcccugcuucuggguggagcugguccgcggccucccgcgggagaacaccaccaucuggaccucgggguccagcaucuccuucugcggcgugaacagcgacacggccaacugguccuggcccgacggggccgagcugcccuucaccaucgacaaguga

SEQ ID NO: 19242 - RNA, 1413 nt, Artificial Sequence
  derived and/or modified CDS sequence (AUadapt) from InfluenzaA__ACR15472__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccccggucacccuggccggcaacucgucccugugcagcaucuccggcugggccaucuacaccaaggacaacucgauccggaucggguccaagggcgacguguucgugauccgcgagcccuucaucgccugcagccaccucgagugccggacguucuuccugacccagggggcccugcucaacgacaagcacuccaacggcaccgucaaggaccgcagccccuaccgggcgcugauguccugcccccugggggaggccccgucgcccuacaacuccaaguucgagagcguggccuggucggccuccgcgugccacgacggcaugggcuggcucaccaucgggaucagcggccccgacaacggggccguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagucgaucgagcucaacgcgccgaacuuccacuacgaggagugcuccugcuaccccgacaccggcaucgucaugugcgugugccgggacaacuggcacgggagcaaccgccccuggguguccuucaaccagaaccuggacuaccagaucggcuacaucugcagcggcgucuucggggacaacccccggccggaggacggcgagggguccugcaaccccgugaccguggacggcgccaacggggucaagggcuucucguacaaguacgacaacggcguguggaucgggcgcacgaaguccaaccggcugcgcaagggcuucgaggugaucugggaccccaacggguggaccaacaccgacagcgacuucuccgucaagcaggacgugguggccaucaccgacuggucgggcuacuccgggagcuucguccagcaccccgagcucacgggccuggacugcauccggccgugcuucuggguggagcugguccgcggccucccccgggagaacaccaccaucuggaccucgggguccagcaucuccuucugcggcgugaacagcgacacggccaacugguccuggcccgacggggccgagcugcccuucaccaucgacaaguga

SEQ ID NO: 19243 - RNA, 1413 nt, Artificial Sequence; identical to SEQ ID NO: 19034
  derived and/or modified CDS sequence (AUadapt) from InfluenzaA__ACR15483__NA

SEQ ID NO: 19244 - RNA, 1413 nt, Artificial Sequence; identical to SEQ ID NO: 19034
  derived and/or modified CDS sequence (AUadapt) from InfluenzaA__ACR15505__NA

SEQ ID NO: 19245 - RNA, 1413 nt, Artificial Sequence; identical to SEQ ID NO: 19118
  derived and/or modified CDS sequence (AUadapt) from InfluenzaA__ACR15516__NA

SEQ ID NO: 19246 - RNA, 1410 nt, Artificial Sequence; identical to SEQ ID NO: 17116
  derived and/or modified CDS sequence (AUadapt) from InfluenzaA__ACR15527__NA

SEQ ID NO: 19247 - RNA, 1410 nt, Artificial Sequence
  derived and/or modified CDS sequence (AUadapt) from InfluenzaA__ACR15538__NA
augauccccauccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucagcgagaagcugcgcuccggcuacgagaccuucaaggucaucgagggguggucgaaccccaacuccaagcugcagaucaaccgccaggugaucguggaccggggcaaccggagcggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19248 - RNA, 1410 nt, Artificial Sequence; identical to SEQ ID NO: 16729
  derived and/or modified CDS sequence (AUadapt) from InfluenzaA__ACR15549__NA

SEQ ID NO: 19249 - RNA, 1410 nt, Artificial Sequence; identical to SEQ ID NO: 17114
  derived and/or modified CDS sequence (AUadapt) from InfluenzaA__ACR15560__NA

SEQ ID NO: 19250 - RNA, 1410 nt, Artificial Sequence; identical to SEQ ID NO: 17114
  derived and/or modified CDS sequence (AUadapt) from InfluenzaA__ACR15582__NA

SEQ ID NO: 19251 - RNA, 1410 nt, Artificial Sequence
  derived and/or modified CDS sequence (AUadapt) from InfluenzaA__ACR15593__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcaggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccugggccaggggaccacgcucaacaacgugcacuccaacgacaccguccacgaccgcaccccguaccggacccugcugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucguggacuccaucgucucgugguccaaggagauccugcggacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccuggaccccaacaacgaggagggcgggcacggggucaagggcugggccuucgacgacgggaacgacguguggaugggccggaccaucucggagaagcuccgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 19252 - RNA, 1410 nt, Artificial Sequence
  derived and/or modified CDS sequence (AUadapt) from InfluenzaA__ACR15604__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcgaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19253 - RNA, 1410 nt, Artificial Sequence; identical to SEQ ID NO: 16274
  derived and/or modified CDS sequence (AUadapt) from InfluenzaA__ACR15618__NA

SEQ ID NO: 19254 - RNA, 1410 nt, Artificial Sequence; identical to SEQ ID NO: 16274
  derived and/or modified CDS sequence (AUadapt) from InfluenzaA__ACR18924__NA

SEQ ID NO: 19255 - RNA, 1410 nt, Artificial Sequence; identical to SEQ ID NO: 16274
  derived and/or modified CDS sequence (AUadapt) from InfluenzaA__ACR18925__NA

SEQ ID NO: 19256 - RNA, 1410 nt, Artificial Sequence; identical to SEQ ID NO: 16318
  derived and/or modified CDS sequence (AUadapt) from InfluenzaA__ACR18926__NA

SEQ ID NO: 19257 - RNA, 1410 nt, Artificial Sequence; identical to SEQ ID NO: 16318
  derived and/or modified CDS sequence (AUadapt) from InfluenzaA__ACR18927__NA

SEQ ID NO: 19258 - RNA, 1410 nt, Artificial Sequence; identical to SEQ ID NO: 16318
  derived and/or modified CDS sequence (AUadapt) from InfluenzaA__ACR18928__NA

SEQ ID NO: 19259 - RNA, 1410 nt, Artificial Sequence; identical to SEQ ID NO: 16318
  derived and/or modified CDS sequence (AUadapt) from InfluenzaA__ACR18929__NA

SEQ ID NO: 19260 - RNA, 1410 nt, Artificial Sequence; identical to SEQ ID NO: 16318
  derived and/or modified CDS sequence (AUadapt) from InfluenzaA__ACR18930__NA

SEQ ID NO: 19261 - RNA, 1410 nt, Artificial Sequence; identical to SEQ ID NO: 16318
  derived and/or modified CDS sequence (AUadapt) from InfluenzaA__ACR18931__NA

SEQ ID NO: 19262 - RNA, 1410 nt, Artificial Sequence; identical to SEQ ID NO: 16318
  derived and/or modified CDS sequence (AUadapt) from InfluenzaA__ACR18933__NA

SEQ ID NO: 19263 - RNA, 1410 nt, Artificial Sequence; identical to SEQ ID NO: 16274
  derived and/or modified CDS sequence (AUadapt) from InfluenzaA__ACR18934__NA

SEQ ID NO: 19264 - RNA, 1410 nt, Artificial Sequence; identical to SEQ ID NO: 16318
  derived and/or modified CDS sequence (AUadapt) from InfluenzaA__ACR18935__NA

SEQ ID NO: 19265 - RNA, 1410 nt, Artificial Sequence; identical to SEQ ID NO: 16318
  derived and/or modified CDS sequence (AUadapt) from InfluenzaA__ACR23301__NA

SEQ ID NO: 19266 - RNA, 1410 nt, Artificial Sequence; identical to SEQ ID NO: 16318
  derived and/or modified CDS sequence (AUadapt) from InfluenzaA__ACR32997__NA

SEQ ID NO: 19267 - RNA, 1410 nt, Artificial Sequence
  derived and/or modified CDS sequence (AUadapt) from InfluenzaA__ACR33740__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgggaccgucggcugguccuggcccgacggcgccgagcugccguucacgaucgacaaguga

SEQ ID NO: 19268 - RNA, 1410 nt, Artificial Sequence; identical to SEQ ID NO: 16274
  derived and/or modified CDS sequence (AUadapt) from InfluenzaA__ACR38792__NA

SEQ ID NO: 19269 - RNA, 1410 nt, Artificial Sequence; identical to SEQ ID NO: 16318
  derived and/or modified CDS sequence (AUadapt) from InfluenzaA__ACR38793__NA

SEQ ID NO: 19270 - RNA, 1410 nt, Artificial Sequence; identical to SEQ ID NO: 16318
  derived and/or modified CDS sequence (AUadapt) from InfluenzaA__ACR38794__NA

SEQ ID NO: 19271 - RNA, 1410 nt, Artificial Sequence; identical to SEQ ID NO: 16318
  derived and/or modified CDS sequence (AUadapt) from InfluenzaA__ACR38878__NA

SEQ ID NO: 19272 - RNA, 1410 nt, Artificial Sequence; identical to SEQ ID NO: 16318
  derived and/or modified CDS sequence (AUadapt) from InfluenzaA__ACR39357__NA

SEQ ID NO: 19273 - RNA, 1410 nt, Artificial Sequence; identical to SEQ ID NO: 16318
  derived and/or modified CDS sequence (AUadapt) from InfluenzaA__ACR39396__NA

SEQ ID NO: 19274 - RNA, 1410 nt, Artificial Sequence; identical to SEQ ID NO: 16318
  derived and/or modified CDS sequence (AUadapt) from InfluenzaA__ACR39406__NA

SEQ ID NO: 19275 - RNA, 1410 nt, Artificial Sequence; identical to SEQ ID NO: 16318
  derived and/or modified CDS sequence (AUadapt) from InfluenzaA__ACR39416__NA

SEQ ID NO: 19276 - RNA, 1410 nt, Artificial Sequence; identical to SEQ ID NO: 16318
  derived and/or modified CDS sequence (AUadapt) from InfluenzaA__ACR39426__NA

SEQ ID NO: 19277 - RNA, 1410 nt, Artificial Sequence; identical to SEQ ID NO: 16318
  derived and/or modified CDS sequence (AUadapt) from InfluenzaA__ACR39436__NA

SEQ ID NO: 19278 - RNA, 1410 nt, Artificial Sequence; identical to SEQ ID NO: 16318
  derived and/or modified CDS sequence (AUadapt) from InfluenzaA__ACR39446__NA

SEQ ID NO: 19279 - RNA, 1410 nt, Artificial Sequence; identical to SEQ ID NO: 16318
  derived and/or modified CDS sequence (AUadapt) from InfluenzaA__ACR39456__NA

SEQ ID NO: 19280 - RNA, 1410 nt, Artificial Sequence; identical to SEQ ID NO: 16318
  derived and/or modified CDS sequence (AUadapt) from InfluenzaA__ACR39466__NA

SEQ ID NO: 19281 - RNA, 1410 nt, Artificial Sequence; identical to SEQ ID NO: 16318
  derived and/or modified CDS sequence (AUadapt) from InfluenzaA__ACR39476__NA

SEQ ID NO: 19282 - RNA, 1410 nt, Artificial Sequence; identical to SEQ ID NO: 16318
  derived and/or modified CDS sequence (AUadapt) from InfluenzaA__ACR39486__NA

SEQ ID NO: 19283 - RNA, 1410 nt, Artificial Sequence; identical to SEQ ID NO: 16318
  derived and/or modified CDS sequence (AUadapt) from InfluenzaA__ACR39496__NA

SEQ ID NO: 19284 - RNA, 1410 nt, Artificial Sequence; identical to SEQ ID NO: 16318
  derived and/or modified CDS sequence (AUadapt) from InfluenzaA__ACR40291__NA

SEQ ID NO: 19285 - RNA, 1410 nt, Artificial Sequence; identical to SEQ ID NO: 16318
  derived and/or modified CDS sequence (AUadapt) from InfluenzaA__ACR40301__NA

SEQ ID NO: 19286 - RNA, 1410 nt, Artificial Sequence
  derived and/or modified CDS sequence (AUadapt) from InfluenzaA__ACR40311__NA
augaaccccaaccagaagaucaucaccaucggcucggugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 19287 - RNA, 1410 nt, Artificial Sequence
  derived and/or modified CDS sequence (AUadapt) from InfluenzaA__ACR40321__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaacggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 19288 - RNA, 1410 nt, Artificial Sequence; identical to SEQ ID NO: 16318
  derived and/or modified CDS sequence (AUadapt) from InfluenzaA__ACR40341__NA

SEQ ID NO: 19289 - RNA, 1410 nt, Artificial Sequence; identical to SEQ ID NO: 16318
  derived and/or modified CDS sequence (AUadapt) from InfluenzaA__ACR40351__NA

SEQ ID NO: 19290 - RNA, 1410 nt, Artificial Sequence; identical to SEQ ID NO: 16318
  derived and/or modified CDS sequence (AUadapt) from InfluenzaA__ACR40361__NA

SEQ ID NO: 19291 - RNA, 1410 nt, Artificial Sequence; identical to SEQ ID NO: 16318
  derived and/or modified CDS sequence (AUadapt) from InfluenzaA__ACR40371__NA

SEQ ID NO: 19292 - RNA, 1410 nt, Artificial Sequence; identical to SEQ ID NO: 16318
  derived and/or modified CDS sequence (AUadapt) from InfluenzaA__ACR40391__NA

SEQ ID NO: 19293 - RNA, 1410 nt, Artificial Sequence; identical to SEQ ID NO: 16274
  derived and/or modified CDS sequence (AUadapt) from InfluenzaA__ACR46663__NA

SEQ ID NO: 19294 - RNA, 1410 nt, Artificial Sequence; identical to SEQ ID NO: 16274
  derived and/or modified CDS sequence (AUadapt) from InfluenzaA__ACR46673__NA

SEQ ID NO: 19295 - RNA, 1410 nt, Artificial Sequence
  derived and/or modified CDS sequence (AUadapt) from InfluenzaA__ACR46996__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19296 - RNA, 1410 nt, Artificial Sequence; identical to SEQ ID NO: 19295
  derived and/or modified CDS sequence (AUadapt) from InfluenzaA__ACR46997__NA

SEQ ID NO: 19297 - RNA, 1410 nt, Artificial Sequence; identical to SEQ ID NO: 19295
  derived and/or modified CDS sequence (AUadapt) from InfluenzaA__ACR46998__NA

SEQ ID NO: 19298 - RNA, 1410 nt, Artificial Sequence; identical to SEQ ID NO: 19295
  derived and/or modified CDS sequence (AUadapt) from InfluenzaA__ACR46999__NA

SEQ ID NO: 19299 - RNA, 1410 nt, Artificial Sequence; identical to SEQ ID NO: 19295
  derived and/or modified CDS sequence (AUadapt) from InfluenzaA__ACR47000__NA

SEQ ID NO: 19300 - RNA, 1410 nt, Artificial Sequence; identical to SEQ ID NO: 19295
  derived and/or modified CDS sequence (AUadapt) from InfluenzaA__ACR47001__NA

SEQ ID NO: 19301 - RNA, 1410 nt, Artificial Sequence; identical to SEQ ID NO: 19295
  derived and/or modified CDS sequence (AUadapt) from InfluenzaA__ACR47002__NA

SEQ ID NO: 19302 - RNA, 1410 nt, Artificial Sequence; identical to SEQ ID NO: 19295
  derived and/or modified CDS sequence (AUadapt) from InfluenzaA__ACR47003__NA

SEQ ID NO: 19303 - RNA, 1410 nt, Artificial Sequence
  derived and/or modified CDS sequence (AUadapt) from InfluenzaA__ACR47008__NA
augaaccccaaccagaagaucaucaccaucggcucggugugcaugaccaucgggauggccaaccugauccuccagaucggcaacaucaucuccaucuggccgguccacagcauccagcuggggaaccagaaccagaucgagacgugcaaccaguccgugaucaccuacgagaacaacaccugggugaaccagaccuacgucaacaucagcaacacgaacuucgccgcgggccaguccguggugucgaugaagcuggccgggaacuccagccucugccccgucggcggcugggccaucuacuccaaggacaacagcgugcgcaucggguccaagggcgacguguucgucauccgggagcccuucaucagcugcucgccccuggagugccgcaccuucuuccugacccagggggcccuccugaacgacaagcacuccaacggcaccaucaaggaccgguccccguaccgcacgcugaugagcugccccaucggggaggugcccucccccuacaacagccgguucgaguccguggccuggagcgcgucggccugccacgacggcaucaacuggcucaccaucggcaucuccgggccggacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggccccuccaacgggcaggccagcuacaagaucuuccgcaucgagaagggcaagaucgugaaguccguggagaugaacgcccccaacuaccacuacgaggagugcucgugcuaccccgacuccagcgagaucacgugcgucugccgggacaacuggcacggguccaaccgcccgugggugagcuucaaccagaaccucgaguaccagaucggcuacaucugcuccgggaucuucggcgacaacccccggcccaacgacaagaccggcagcugcgggcccguguccucgaacggcgccaacggggucaagggcuucuccuucaaguacgggaacggcguguggaucggccgcaccaagagcaucuccagccggaacggguucgagaugaucugggacccgaacggcuggaccgggaccgacaacaacuucagcaucaagcaggacaucgugggcaucaacgagugguccggguacucgggcuccuucguccagcaccccgagcugacgggccuggacugcauccgccccugcuucuggguggagcucauccgggggcgccccaaggagaacaccaucuggaccagcggcuccagcaucuccuucugcggggucaacagcgacaccgugggcugguccuggccggacggcgccgagcugcccuucacgaucgacaaguga

SEQ ID NO: 19304 - RNA, 1410 nt, Artificial Sequence; identical to SEQ ID NO: 16318
  derived and/or modified CDS sequence (AUadapt) from InfluenzaA__ACR49267__NA

SEQ ID NO: 19305 - RNA, 1410 nt, Artificial Sequence; identical to SEQ ID NO: 16274
  derived and/or modified CDS sequence (AUadapt) from InfluenzaA__ACR49268__NA

SEQ ID NO: 19306 - RNA, 1410 nt, Artificial Sequence; identical to SEQ ID NO: 16274
  derived and/or modified CDS sequence (AUadapt) from InfluenzaA__ACR49269__NA

SEQ ID NO: 19307 - RNA, 1410 nt, Artificial Sequence; identical to SEQ ID NO: 16274
  derived and/or modified CDS sequence (AUadapt) from InfluenzaA__ACR49270__NA

SEQ ID NO: 19308 - RNA, 1410 nt, Artificial Sequence; identical to SEQ ID NO: 19170
  derived and/or modified CDS sequence (AUadapt) from InfluenzaA__ACR49271__NA

SEQ ID NO: 19309 - RNA, 1410 nt, Artificial Sequence; identical to SEQ ID NO: 16318
  derived and/or modified CDS sequence (AUadapt) from InfluenzaA__ACR49272__NA

SEQ ID NO: 19310 - RNA, 1410 nt, Artificial Sequence; identical to SEQ ID NO: 16274
  derived and/or modified CDS sequence (AUadapt) from InfluenzaA__ACR49273__NA

SEQ ID NO: 19311 - RNA, 1410 nt, Artificial Sequence; identical to SEQ ID NO: 16274
  derived and/or modified CDS sequence (AUadapt) from InfluenzaA__ACR49274__NA

SEQ ID NO: 19312 - RNA, 1410 nt, Artificial Sequence; identical to SEQ ID NO: 19170
  derived and/or modified CDS sequence (AUadapt) from InfluenzaA__ACR49275__NA

SEQ ID NO: 19313 - RNA, 1410 nt, Artificial Sequence; identical to SEQ ID NO: 19170
  derived and/or modified CDS sequence (AUadapt) from InfluenzaA__ACR49277__NA

SEQ ID NO: 19314 - RNA, 1410 nt, Artificial Sequence; identical to SEQ ID NO: 19170
  derived and/or modified CDS sequence (AUadapt) from InfluenzaA__ACR49278__NA

SEQ ID NO: 19315 - RNA, 1410 nt, Artificial Sequence; identical to SEQ ID NO: 16274
  derived and/or modified CDS sequence (AUadapt) from InfluenzaA__ACR49279__NA

SEQ ID NO: 19316 - RNA, 1410 nt, Artificial Sequence; identical to SEQ ID NO: 16274
  derived and/or modified CDS sequence (AUadapt) from InfluenzaA__ACR50994__NA

SEQ ID NO: 19317 - RNA, 1410 nt, Artificial Sequence; identical to SEQ ID NO: 16318
  derived and/or modified CDS sequence (AUadapt) from InfluenzaA__ACR50998__NA

SEQ ID NO: 19318 - RNA, 1410 nt, Artificial Sequence; identical to SEQ ID NO: 16318
  derived and/or modified CDS sequence (AUadapt) from InfluenzaA__ACR51008__NA

SEQ ID NO: 19319 - RNA, 1410 nt, Artificial Sequence; identical to SEQ ID NO: 16318
  derived and/or modified CDS sequence (AUadapt) from InfluenzaA__ACR51018__NA

SEQ ID NO: 19320 - RNA, 1410 nt, Artificial Sequence; identical to SEQ ID NO: 16318
  derived and/or modified CDS sequence (AUadapt) from InfluenzaA__ACR51028__NA

SEQ ID NO: 19321 - RNA, 1410 nt, Artificial Sequence
  derived and/or modified CDS sequence (AUadapt) from InfluenzaA__ACR51038__NA
augaaccccaaccagaagaucaucaccaucggcucggugugcauguccaucgggauggccaaccugauccuccagaucggcaacaucaucagcaucuggaucucccacagcauccagcuggggaaccagaaccagaucgagaccugcaaccaguccgucaucacguacgagaacaacaccugggugaaccagaccuacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggucgcccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagucggagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 19322 - RNA, 1410 nt, Artificial Sequence; identical to SEQ ID NO: 16318
  derived and/or modified CDS sequence (AUadapt) from InfluenzaA__ACR51048__NA

SEQ ID NO: 19323 - RNA, 1410 nt, Artificial Sequence; identical to SEQ ID NO: 16318
  derived and/or modified CDS sequence (AUadapt) from InfluenzaA__ACR51058__NA

SEQ ID NO: 19324 - RNA, 1410 nt, Artificial Sequence; identical to SEQ ID NO: 16274
  derived and/or modified CDS sequence (AUadapt) from InfluenzaA__ACR51068__NA

SEQ ID NO: 19325 - RNA, 1410 nt, Artificial Sequence; identical to SEQ ID NO: 16318
  derived and/or modified CDS sequence (AUadapt) from InfluenzaA__ACR52371__NA

SEQ ID NO: 19326 - RNA, 1410 nt, Artificial Sequence; identical to SEQ ID NO: 16318
  derived and/or modified CDS sequence (AUadapt) from InfluenzaA__ACR52381__NA

SEQ ID NO: 19327 - RNA, 1410 nt, Artificial Sequence; identical to SEQ ID NO: 16318
  derived and/or modified CDS sequence (AUadapt) from InfluenzaA__ACR52391__NA

SEQ ID NO: 19328 - RNA, 1410 nt, Artificial Sequence; identical to SEQ ID NO: 16318
  derived and/or modified CDS sequence (AUadapt) from InfluenzaA__ACR52401__NA

SEQ ID NO: 19329 - RNA, 1410 nt, Artificial Sequence; identical to SEQ ID NO: 16318
  derived and/or modified CDS sequence (AUadapt) from InfluenzaA__ACR52411__NA

SEQ ID NO: 19330 - RNA, 1410 nt, Artificial Sequence; identical to SEQ ID NO: 16318
  derived and/or modified CDS sequence (AUadapt) from InfluenzaA__ACR52421__NA

SEQ ID NO: 19331 - RNA, 1410 nt, Artificial Sequence; identical to SEQ ID NO: 16318
  derived and/or modified CDS sequence (AUadapt) from InfluenzaA__ACR52431__NA

SEQ ID NO: 19332 - RNA, 1410 nt, Artificial Sequence; identical to SEQ ID NO: 16318
  derived and/or modified CDS sequence (AUadapt) from InfluenzaA__ACR52441__NA

SEQ ID NO: 19333 - RNA, 1410 nt, Artificial Sequence; identical to SEQ ID NO: 16318
  derived and/or modified CDS sequence (AUadapt) from InfluenzaA__ACR52451__NA

SEQ ID NO: 19334 - RNA, 1410 nt, Artificial Sequence; identical to SEQ ID NO: 16318
  derived and/or modified CDS sequence (AUadapt) from InfluenzaA__ACR52471__NA

SEQ ID NO: 19335 - RNA, 1410 nt, Artificial Sequence; identical to SEQ ID NO: 16318
  derived and/or modified CDS sequence (AUadapt) from InfluenzaA__ACR52481__NA

SEQ ID NO: 19336 - RNA, 1410 nt, Artificial Sequence; identical to SEQ ID NO: 16318
  derived and/or modified CDS sequence (AUadapt) from InfluenzaA__ACR52491__NA

SEQ ID NO: 19337 - RNA, 1410 nt, Artificial Sequence; identical to SEQ ID NO: 16318
  derived and/or modified CDS sequence (AUadapt) from InfluenzaA__ACR54046__NA

SEQ ID NO: 19338 - RNA, 1410 nt, Artificial Sequence; identical to SEQ ID NO: 16274
  derived and/or modified CDS sequence (AUadapt) from InfluenzaA__ACR54052__NA

SEQ ID NO: 19339 - RNA, 1410 nt, Artificial Sequence; identical to SEQ ID NO: 16318
  derived and/or modified CDS sequence (AUadapt) from InfluenzaA__ACR54966__NA

SEQ ID NO: 19340 - RNA, 1410 nt, Artificial Sequence; identical to SEQ ID NO: 16318
  derived and/or modified CDS sequence (AUadapt) from InfluenzaA__ACR54976__NA

SEQ ID NO: 19341 - RNA, 1410 nt, Artificial Sequence; identical to SEQ ID NO: 16318
  derived and/or modified CDS sequence (AUadapt) from InfluenzaA__ACR54986__NA

SEQ ID NO: 19342 - RNA, 1410 nt, Artificial Sequence; identical to SEQ ID NO: 16274
  derived and/or modified CDS sequence (AUadapt) from InfluenzaA__ACR54996__NA

SEQ ID NO: 19343 - RNA, 1410 nt, Artificial Sequence; identical to SEQ ID NO: 16318
  derived and/or modified CDS sequence (AUadapt) from InfluenzaA__ACR55006__NA

SEQ ID NO: 19344 - RNA, 1410 nt, Artificial Sequence; identical to SEQ ID NO: 16274
  derived and/or modified CDS sequence (AUadapt) from InfluenzaA__ACR56383__NA

SEQ ID NO: 19345 - RNA, 1410 nt, Artificial Sequence; identical to SEQ ID NO: 16274
  derived and/or modified CDS sequence (AUadapt) from InfluenzaA__ACR56393__NA

SEQ ID NO: 19346 - RNA, 1410 nt, Artificial Sequence; identical to SEQ ID NO: 16318
  derived and/or modified CDS sequence (AUadapt) from InfluenzaA__ACR56403__NA

SEQ ID NO: 19347 - RNA, 1410 nt, Artificial Sequence; identical to SEQ ID NO: 16318
  derived and/or modified CDS sequence (AUadapt) from InfluenzaA__ACR56413__NA

SEQ ID NO: 19348 - RNA, 1410 nt, Artificial Sequence; identical to SEQ ID NO: 16318
  derived and/or modified CDS sequence (AUadapt) from InfluenzaA__ACR56423__NA

SEQ ID NO: 19349 - RNA, 1410 nt, Artificial Sequence; identical to SEQ ID NO: 16318
  derived and/or modified CDS sequence (AUadapt) from InfluenzaA__ACR56433__NA

SEQ ID NO: 19350 - RNA, 1410 nt, Artificial Sequence; identical to SEQ ID NO: 16318
  derived and/or modified CDS sequence (AUadapt) from InfluenzaA__ACR56443__NA

SEQ ID NO: 19351 - RNA, 1410 nt, Artificial Sequence; identical to SEQ ID NO: 16318
  derived and/or modified CDS sequence (AUadapt) from InfluenzaA__ACR56453__NA

SEQ ID NO: 19352 - RNA, 1413 nt, Artificial Sequence; identical to SEQ ID NO: 19118
  derived and/or modified CDS sequence (AUadapt) from InfluenzaA__ACR58555__NA

SEQ ID NO: 19353 - RNA, 1413 nt, Artificial Sequence
  derived and/or modified CDS sequence (AUadapt) from InfluenzaA__ACR61658__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucucgaucaacaacacgaacguggugaccgggaaggacaagaccuccgucacccuggcgggcaacagcucccugugcagcaucuccggcugggccaucuacacgaaggacaacucgauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcccccagcccguacaacuccaaguucgagucgguggcgugguccgccagcgccugccacgacggcaugggcuggcucacgaucgggaucuccggccccgacaacggggccguggcgguccugaaguacaacggcaucaucaccgagaccaucaagucguggaagaagcgcauccugcggacccaggaguccgagugcgugugcgugaacggcagcugcuucacgaucaugaccgacgggcccuccaacggcgccgccagcuacaagaucuucaagaucgagaaggggaaggucaccaaguccaucgagcucaacgcccccaacuuccacuacgaggagugcucgugcuacccggacaccggcacggugaugugcgugugccgcgacaacuggcacggguccaaccggcccugggucagcuucaaccagaaccuggacuaccagaucggcuacaucugcuccggcguguucggggacaacccccgccccaaggacggcaaggggucgugcaacccggugaccgucgacggcgccgacggggugaagggcuucuccuacaaguacggcaacgggguguggaucggccggaccaagagcaaccgccugcggaagggguucgagaugaucugggaccccaacggcuggaccgacacggacuccgacuucagcgucaagcaggacgugguggcgaucaccgacuggucgggguacuccggcagcuucguccagcaccccgagcucaccggccuggacugcauccgccccugcuucuggguggagcugguccgggggcucccgcgcgagaacaccacgaucuggaccuccggcucguccaucagcuucugcgggguggacuccgacaccgccaacuggagcuggcccgacggcgccgagcugcccuucaccaucgacaaguga

SEQ ID NO: 19354 - RNA, 1410 nt, Artificial Sequence
  derived and/or modified CDS sequence (AUadapt) from InfluenzaA__ACR61680__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaucguggucaugaccgacggguccgccagcggcaaggccgacaccaagauccucuucaucgaggagggcaagaucgugcacaccucgacgcuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 19355 - RNA, 1410 nt, Artificial Sequence
  derived and/or modified CDS sequence (AUadapt) from InfluenzaA__ACR61691__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccacaagcuggccgaguaccggaacuggucgaagccccagugcgacaucaccggguucgcgccguucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggacccccuaccgcacccugcucaugaacgagcugggcgugccguuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgccccaucguggacaucaacaucaaggaccacuccaucgucucguccuacgugugcagcggccuggugggcgacaccccgcggaagaacgacuccucguccagcucccacugccucgaccccaacaacgaggagggcgggcacggggucaagggcugggccuucgacgacgggaacgacguguggaugggccgcaccaucucggagaagucccggcugggcuacgagacguucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgacaucaaccugaugccgaucuga

SEQ ID NO: 19356 - RNA, 1410 nt, Artificial Sequence
  derived and/or modified CDS sequence (AUadapt) from InfluenzaA__ACR61702__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcuccaacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 19357 - RNA, 1410 nt, Artificial Sequence; identical to SEQ ID NO: 16274
  derived and/or modified CDS sequence (AUadapt) from InfluenzaA__ACR67201__NA

SEQ ID NO: 19358 - RNA, 1410 nt, Artificial Sequence; identical to SEQ ID NO: 16318
  derived and/or modified CDS sequence (AUadapt) from InfluenzaA__ACR67202__NA

SEQ ID NO: 19359 - RNA, 1410 nt, Artificial Sequence; identical to SEQ ID NO: 16274
  derived and/or modified CDS sequence (AUadapt) from InfluenzaA__ACR67203__NA

SEQ ID NO: 19360 - RNA, 1410 nt, Artificial Sequence; identical to SEQ ID NO: 16318
  derived and/or modified CDS sequence (AUadapt) from InfluenzaA__ACR67204__NA

SEQ ID NO: 19361 - RNA, 1410 nt, Artificial Sequence; identical to SEQ ID NO: 16318
  derived and/or modified CDS sequence (AUadapt) from InfluenzaA__ACR67246__NA

SEQ ID NO: 19362 - RNA, 1410 nt, Artificial Sequence; identical to SEQ ID NO: 16274
  derived and/or modified CDS sequence (AUadapt) from InfluenzaA__ACR67256__NA

SEQ ID NO: 19363 - RNA, 1410 nt, Artificial Sequence; identical to SEQ ID NO: 16318
  derived and/or modified CDS sequence (AUadapt) from InfluenzaA__ACR77451__NA

SEQ ID NO: 19364 - RNA, 1410 nt, Artificial Sequence; identical to SEQ ID NO: 16318
  derived and/or modified CDS sequence (AUadapt) from InfluenzaA__ACR77461__NA

SEQ ID NO: 19365 - RNA, 1410 nt, Artificial Sequence; identical to SEQ ID NO: 16318
  derived and/or modified CDS sequence (AUadapt) from InfluenzaA__ACR77471__NA

SEQ ID NO: 19366 - RNA, 1410 nt, Artificial Sequence; identical to SEQ ID NO: 16318
  derived and/or modified CDS sequence (AUadapt) from InfluenzaA__ACR77481__NA

SEQ ID NO: 19367 - RNA, 1410 nt, Artificial Sequence; identical to SEQ ID NO: 16318
  derived and/or modified CDS sequence (AUadapt) from InfluenzaA__ACR77491__NA

SEQ ID NO: 19368 - RNA, 1410 nt, Artificial Sequence; identical to SEQ ID NO: 16318
  derived and/or modified CDS sequence (AUadapt) from InfluenzaA__ACR77501__NA

SEQ ID NO: 19369 - RNA, 1410 nt, Artificial Sequence; identical to SEQ ID NO: 16318
  derived and/or modified CDS sequence (AUadapt) from InfluenzaA__ACR83527__NA

SEQ ID NO: 19370 - RNA, 1410 nt, Artificial Sequence; identical to SEQ ID NO: 16318
  derived and/or modified CDS sequence (AUadapt) from InfluenzaA__ACR83539__NA

SEQ ID NO: 19371 - RNA, 1410 nt, Artificial Sequence; identical to SEQ ID NO: 16318
  derived and/or modified CDS sequence (AUadapt) from InfluenzaA__ACS14669__NA

SEQ ID NO: 19372 - RNA, 1410 nt, Artificial Sequence; identical to SEQ ID NO: 16318
  derived and/or modified CDS sequence (AUadapt) from InfluenzaA__ACS14679__NA

SEQ ID NO: 19373 - RNA, 1410 nt, Artificial Sequence; identical to SEQ ID NO: 16318
  derived and/or modified CDS sequence (AUadapt) from InfluenzaA__ACS14689__NA

SEQ ID NO: 19374 - RNA, 1410 nt, Artificial Sequence; identical to SEQ ID NO: 16318
  derived and/or modified CDS sequence (AUadapt) from InfluenzaA__ACS14699__NA

SEQ ID NO: 19375 - RNA, 1410 nt, Artificial Sequence; identical to SEQ ID NO: 16318
  derived and/or modified CDS sequence (AUadapt) from InfluenzaA__ACS14709__NA

SEQ ID NO: 19376 - RNA, 1410 nt, Artificial Sequence; identical to SEQ ID NO: 16318
  derived and/or modified CDS sequence (AUadapt) from InfluenzaA__ACS14719__NA

SEQ ID NO: 19377 - RNA, 1410 nt, Artificial Sequence; identical to SEQ ID NO: 16318
  derived and/or modified CDS sequence (AUadapt) from InfluenzaA__ACS14729__NA

SEQ ID NO: 19378 - RNA, 1410 nt, Artificial Sequence; identical to SEQ ID NO: 16318
  derived and/or modified CDS sequence (AUadapt) from InfluenzaA__ACS14739__NA

SEQ ID NO: 19379 - RNA, 1410 nt, Artificial Sequence; identical to SEQ ID NO: 16274
  derived and/or modified CDS sequence (AUadapt) from InfluenzaA__ACS27192__NA

SEQ ID NO: 19380 - RNA, 1410 nt, Artificial Sequence; identical to SEQ ID NO: 16318
  derived and/or modified CDS sequence (AUadapt) from InfluenzaA__ACS27202__NA

SEQ ID NO: 19381 - RNA, 1410 nt, Artificial Sequence; identical to SEQ ID NO: 16318
  derived and/or modified CDS sequence (AUadapt) from InfluenzaA__ACS27212__NA

SEQ ID NO: 19382 - RNA, 1410 nt, Artificial Sequence; identical to SEQ ID NO: 16274
  derived and/or modified CDS sequence (AUadapt) from InfluenzaA__ACS27222__NA

SEQ ID NO: 19383 - RNA, 1410 nt, Artificial Sequence; identical to SEQ ID NO: 16318
  derived and/or modified CDS sequence (AUadapt) from InfluenzaA__ACS27232__NA

SEQ ID NO: 19384 - RNA, 1410 nt, Artificial Sequence; identical to SEQ ID NO: 16274
  derived and/or modified CDS sequence (AUadapt) from InfluenzaA__ACS27242__NA

SEQ ID NO: 19385 - RNA, 1410 nt, Artificial Sequence; identical to SEQ ID NO: 16318
  derived and/or modified CDS sequence (AUadapt) from InfluenzaA__ACS27252__NA

SEQ ID NO: 19386 - RNA, 1410 nt, Artificial Sequence; identical to SEQ ID NO: 16274
  derived and/or modified CDS sequence (AUadapt) from InfluenzaA__ACS27771__NA

SEQ ID NO: 19387 - RNA, 1410 nt, Artificial Sequence; identical to SEQ ID NO: 19295
  derived and/or modified CDS sequence (AUadapt) from InfluenzaA__ACS34969__NA

SEQ ID NO: 19388 - RNA, 1410 nt, Artificial Sequence; identical to SEQ ID NO: 19295
  derived and/or modified CDS sequence (AUadapt) from InfluenzaA__ACS34970__NA

SEQ ID NO: 19389 - RNA, 1410 nt, Artificial Sequence; identical to SEQ ID NO: 19295
  derived and/or modified CDS sequence (AUadapt) from InfluenzaA__ACS34971__NA

SEQ ID NO: 19390 - RNA, 1410 nt, Artificial Sequence; identical to SEQ ID NO: 16318
  derived and/or modified CDS sequence (AUadapt) from InfluenzaA__ACS34972__NA

SEQ ID NO: 19391 - RNA, 1410 nt, Artificial Sequence; identical to SEQ ID NO: 16318
  derived and/or modified CDS sequence (AUadapt) from InfluenzaA__ACS50081__NA

SEQ ID NO: 19392 - RNA, 1410 nt, Artificial Sequence; identical to SEQ ID NO: 16318
  derived and/or modified CDS sequence (AUadapt) from InfluenzaA__ACS50087__NA

SEQ ID NO: 19393 - RNA, 1410 nt, Artificial Sequence; identical to SEQ ID NO: 16318
  derived and/or modified CDS sequence (AUadapt) from InfluenzaA__ACS50094__NA

SEQ ID NO: 19394 - RNA, 1410 nt, Artificial Sequence; identical to SEQ ID NO: 16274
  derived and/or modified CDS sequence (AUadapt) from InfluenzaA__ACS54264__NA

SEQ ID NO: 19395 - RNA, 1410 nt, Artificial Sequence; identical to SEQ ID NO: 19295
  derived and/or modified CDS sequence (AUadapt) from InfluenzaA__ACS54265__NA

SEQ ID NO: 19396 - RNA, 1410 nt, Artificial Sequence; identical to SEQ ID NO: 16318
  derived and/or modified CDS sequence (AUadapt) from InfluenzaA__ACS54266__NA

SEQ ID NO: 19397 - RNA, 1410 nt, Artificial Sequence; identical to SEQ ID NO: 16318
  derived and/or modified CDS sequence (AUadapt) from InfluenzaA__ACS54267__NA

SEQ ID NO: 19398 - RNA, 1410 nt, Artificial Sequence; identical to SEQ ID NO: 16318
  derived and/or modified CDS sequence (AUadapt) from InfluenzaA__ACS54268__NA

SEQ ID NO: 19399 - RNA, 1410 nt, Artificial Sequence; identical to SEQ ID NO: 16318
  derived and/or modified CDS sequence (AUadapt) from InfluenzaA__ACS54303__NA

SEQ ID NO: 19400 - RNA, 1410 nt, Artificial Sequence; identical to SEQ ID NO: 16318
  derived and/or modified CDS sequence (AUadapt) from InfluenzaA__ACS68823__NA

SEQ ID NO: 19401 - RNA, 1410 nt, Artificial Sequence; identical to SEQ ID NO: 16318
  derived and/or modified CDS sequence (AUadapt) from InfluenzaA__ACS75824__NA

SEQ ID NO: 19402 - RNA, 1410 nt, Artificial Sequence; identical to SEQ ID NO: 16318
  derived and/or modified CDS sequence (AUadapt) from InfluenzaA__ACS77929__NA

SEQ ID NO: 19403 - RNA, 1410 nt, Artificial Sequence; identical to SEQ ID NO: 16318
  derived and/or modified CDS sequence (AUadapt) from InfluenzaA__ACS77939__NA

SEQ ID NO: 19404 - RNA, 1410 nt, Artificial Sequence; identical to SEQ ID NO: 16274
  derived and/or modified CDS sequence (AUadapt) from InfluenzaA__ACS77949__NA

SEQ ID NO: 19405 - RNA, 1410 nt, Artificial Sequence; identical to SEQ ID NO: 16318
  derived and/or modified CDS sequence (AUadapt) from InfluenzaA__ACS77959__NA

SEQ ID NO: 19406 - RNA, 1410 nt, Artificial Sequence; identical to SEQ ID NO: 16318
  derived and/or modified CDS sequence (AUadapt) from InfluenzaA__ACS77969__NA

SEQ ID NO: 19407 - RNA, 1410 nt, Artificial Sequence; identical to SEQ ID NO: 16318
  derived and/or modified CDS sequence (AUadapt) from InfluenzaA__ACS77979__NA

SEQ ID NO: 19408 - RNA, 1410 nt, Artificial Sequence; identical to SEQ ID NO: 16318
  derived and/or modified CDS sequence (AUadapt) from InfluenzaA__ACS77989__NA

SEQ ID NO: 19409 - RNA, 1410 nt, Artificial Sequence; identical to SEQ ID NO: 16318
  derived and/or modified CDS sequence (AUadapt) from InfluenzaA__ACS77999__NA

SEQ ID NO: 19410 - RNA, 1410 nt, Artificial Sequence; identical to SEQ ID NO: 16318
  derived and/or modified CDS sequence (AUadapt) from InfluenzaA__ACS78009__NA

SEQ ID NO: 19411 - RNA, 1410 nt, Artificial Sequence; identical to SEQ ID NO: 16318
  derived and/or modified CDS sequence (AUadapt) from InfluenzaA__ACS78019__NA

SEQ ID NO: 19412 - RNA, 1410 nt, Artificial Sequence; identical to SEQ ID NO: 16318
  derived and/or modified CDS sequence (AUadapt) from InfluenzaA__ACS78039__NA

SEQ ID NO: 19413 - RNA, 1410 nt, Artificial Sequence; identical to SEQ ID NO: 16318
  derived and/or modified CDS sequence (AUadapt) from InfluenzaA__ACS78049__NA

SEQ ID NO: 19414 - RNA, 1410 nt, Artificial Sequence; identical to SEQ ID NO: 16318
  derived and/or modified CDS sequence (AUadapt) from InfluenzaA__ACS88274__NA

SEQ ID NO: 19415 - RNA, 1410 nt, Artificial Sequence; identical to SEQ ID NO: 16318
  derived and/or modified CDS sequence (AUadapt) from InfluenzaA__ACS88275__NA

SEQ ID NO: 19416 - RNA, 1410 nt, Artificial Sequence; identical to SEQ ID NO: 16274
  derived and/or modified CDS sequence (AUadapt) from InfluenzaA__ACS92572__NA

SEQ ID NO: 19417 - RNA, 1410 nt, Artificial Sequence; identical to SEQ ID NO: 16274
  derived and/or modified CDS sequence (AUadapt) from InfluenzaA__ACS92582__NA

SEQ ID NO: 19418 - RNA, 1410 nt, Artificial Sequence; identical to SEQ ID NO: 16318
  derived and/or modified CDS sequence (AUadapt) from InfluenzaA__ACS92592__NA

SEQ ID NO: 19419 - RNA, 1410 nt, Artificial Sequence; identical to SEQ ID NO: 16318
  derived and/or modified CDS sequence (AUadapt) from InfluenzaA__ACS92603__NA

SEQ ID NO: 19420 - RNA, 1410 nt, Artificial Sequence; identical to SEQ ID NO: 16274
  derived and/or modified CDS sequence (AUadapt) from InfluenzaA__ACS92614__NA

SEQ ID NO: 19421 - RNA, 1410 nt, Artificial Sequence; identical to SEQ ID NO: 16318
  derived and/or modified CDS sequence (AUadapt) from InfluenzaA__ACT09115__NA

SEQ ID NO: 19422 - RNA, 1410 nt, Artificial Sequence; identical to SEQ ID NO: 16318
  derived and/or modified CDS sequence (AUadapt) from InfluenzaA__ACT10309__NA

SEQ ID NO: 19423 - RNA, 1410 nt, Artificial Sequence; identical to SEQ ID NO: 16318
  derived and/or modified CDS sequence (AUadapt) from InfluenzaA__ACT10315__NA

SEQ ID NO: 19424 - RNA, 1410 nt, Artificial Sequence; identical to SEQ ID NO: 16274
  derived and/or modified CDS sequence (AUadapt) from InfluenzaA__ACT11059__NA

SEQ ID NO: 19425 - RNA, 1350 nt, Artificial Sequence
  derived and/or modified CDS sequence (AUadapt) from InfluenzaA__ACT15313__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacagcaaagauaacuccauccgcaucggcagccggggcgacguguucgucauccgcgagcccuucaucuccugcagccaccuggagugucggaccuucuuccugacgcagggggcccuccugaacgacaagcacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaagaguccgagugugcgugcgucaacggcagcugcuucacggugaugaccgacgggccguccagcggccaggccuccuacaagaucuucaagauggagaagggcaagguggucaagaguguggaacuggacgcccccaacuaccacuacgaggagugcuccugcuaccccgacgccggggagaucacgugugugugccgggacaacuggcacggcagcaaccgccccugggucuccuucaaccagaaucucgaguaccagaucggguacaucugcagcggcguguucggggacaacccgcggcccaacgacggcaccggcuccugugggcccguguuccccaacggcgccuacggggucaagggcuucagcuucaaguacgggaacggcguguggaucggccgcaccaaguccaccaacagucgguccggguucgaaaugaucugggacccgaacggcuggaccgggaccgacagcagcuucuccgugaagcaggacaucgucgcgaucacggauuggagcggcuacuccgggagcuucgugcagcaccccgagcugaccggccuggacugcauccgccccugcuucugggucgagcucauccggggccgccccaaggaguccaccaucuggaccaguggguccagcaucuccuucugcggcgugaacggggacacggugagcugguccuggccggacggcgccgagcugcccuucaccaucgacaaguga

SEQ ID NO: 19426 - RNA, 1350 nt, Artificial Sequence
  derived and/or modified CDS sequence (AUadapt) from InfluenzaA__ACT15315__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacagcaaagauaacuccauccgcaucggcagccggggcgacguguucgucaugcgcgagcccuucaucuccugcagccaccuggagugucggaccuucuuccugacgcagggggcccuccugaacgacaagcacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaagaguccgagugugcgugcgucaacggcagcugcuucacggugaugaccgacgggccguccagcggccaggccuccuacaagaucuucaagauggagaagggcaagguggucaagaguguggaacuggacgcccccaacuaccacuacgaggagugcuccugcuaccccgacgccggggagaucacgugugugugccgggacaacuggcacggcagcaaccgccccugggucuccuucaaccagaaucucgaguaccagaucggguacaucugcagcggcguguucggggacaacccgcggcccaacgacggcaccggcuccugugggcccguguuccccaacggcgccuacggggucaagggcuucagcuucaaguacgggaacggcguguggaucggccgcaccaaguccaccaacagucgguccggguucgaaaugaucugggacccgaacggcuggaccgggaccgacagcagcuucuccgugaagcaggacaucgucgcgaucacggauuggagcggcuacuccgggagcuucgugcagcaccccgagcugaccggccuggacugcauccgccccugcuucugggucgagcucauccggggccgccccaaggaguccaccaucuggaccaguggguccagcaucuccuucugcggcgugaacggggacacggugagcugguccuggccggacggcgccgagcugcccuucaccaucgacaaguga

SEQ ID NO: 19427 - RNA, 1350 nt, Artificial Sequence; identical to SEQ ID NO: 19425
  derived and/or modified CDS sequence (AUadapt) from InfluenzaA__ACT15319__NA

SEQ ID NO: 19428 - RNA, 1350 nt, Artificial Sequence
  derived and/or modified CDS sequence (AUadapt) from InfluenzaA__ACT15321__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaauuccugaccgagcgcgccguggccagcgucacccuggcgggcaacuccagccucugccccaucuccgggugggccguguacagcaaggauaacuccauccggaucggcagccgcggcgacguguucgucauccgggagcccuucaucuccugcagccaccuggagugucgcaccuucuuccugacgcagggggcccuccugaacgacaagcacuccaacggcaccgugaaagaccggagcccccaccgcacccugauguccuguccggugggggaggcccccagccccuacaacucccgguucgagagcgucgccuggagcgcguccgccugccacgacggcaccaguuggcucacgaucgggaucuccggccccgacaacggcgccguggccgugcugaaguacaacgggaucaucaccgacaccaucaagagcuggcgcaacaacaucaugcggacccaggaguccgaaugugcgugcgucaacggcagcugcuucacggugaugaccgacgggccguccagcggccaggccuccuacaagaucuucaagauggagaagggcaagguggucaaaaguguggagcuggacgcccccaacuaccacuacgaggagugcuccugcuaccccgacgccggggagaucacgugugugugccgcgacaacuggcacggcagcaaccggcccugggucuccuucaaccagaaucucgaguaccaaaucggguacaucugcagcggcguguucggggacaacccgcgccccaacgacggcaccggcuccugugggcccguguuccccaacggcgccuacggggucaagggcuucagcuucaaguacgggaacggcguguggaucggccggaccaaguccaccaacagucgcuccggguucgagaugaucugggacccgaacggcuggaccgggaccgacagcagcuucuccgugaagcaggacaucgucgcgaucacggauuggagcggcuacuccgggagcuucgugcaacaccccgagcugaccggccuggacugcauccggcccugcuucugggucgagcucauccgcggccggcccaaggaguccaccaucuggaccaguggguccagcaucuccuucugcggcgugaacggggacacggugagcugguccuggccggacggcgccgagcugcccuucaccaucgacaaguga

SEQ ID NO: 19429 - RNA, 1350 nt, Artificial Sequence; identical to SEQ ID NO: 19425
  derived and/or modified CDS sequence (AUadapt) from InfluenzaA__ACT15323__NA

SEQ ID NO: 19430 - RNA, 1350 nt, Artificial Sequence; identical to SEQ ID NO: 19425
  derived and/or modified CDS sequence (AUadapt) from InfluenzaA__ACT15325__NA

SEQ ID NO: 19431 - RNA, 1350 nt, Artificial Sequence
  derived and/or modified CDS sequence (AUadapt) from InfluenzaA__ACT15327__NA
augaaucccaaccaaaagaucaucaccaucggcagcaucugcauggugaucgggaucgucucccugaugcuccagaucggcaacaugaucagcaucugggugucccacagcauccagaccgggaaccgcugucaggacgagccgaucuccaacacgaaguuccugaccgagaaggccguggccagcgucacccuggcgggcaacuccagccucugccccaucuccgggugggccguguacagcaaggauaacuccauccggaucggcagccgcggcgacguguucgucauccgggagcccuucaucuccugcagccaccuggagugucgcaccuucuuccugacgcaaggggcccuccugaacgacaagcacuccaacggcaccgugaaggaccggagcccccaccgcacccugauguccuguccggugggggaggcccccagccccuacaacucccgguucgagagcgucgccuggagcgcguccgccugccacgacggcaccaguuggcucacgaucgggaucuccggccccgacaacggcgccguggccgugcugaaguacaacgggaucaucaccgacaccaucaagagcuggcgcaacaacaucaugcggacccaggaguccgagugugcgugcgucaacggcagcugcuucacggugaugaccgacgggccguccagcggccaggccuccuacaagaucuucaagauggaaaagggcaagguggucaagaguguggagcuggacgcccccaacuaccacuacgaggagugcuccugcuaccccgacgccggggagaucacgugugugugccgcgacaacuggcacggcagcaaccggcccugggucuccuucaaccagaaucucgaguacaagaucggguacaucugcagcggcaucuucggggacaacccgcgccccaacgacggcaccggcuccugugggcccguguuccccaacggcgccuacggggugaagggcuucagcuucaaauacgggaacggcgucuggaucggccggaccaaguccaccaacagucgcuccggguucgagaugaucugggacccgaacggcuggaccgggaccgacagcagcuucuccgugaagcaggacaucguggcgaucacggauuggagcggcuacuccgggagcuucguccagcaccccgagcugaccggccuggacugcauccggcccugcuucuggguggagcucauccgcggccggcccaaggaguccaccaucuggaccaguggguccagcaucuccuucugcggcgucaacggggacacggugagcugguccuggccggacggcgccgagcugcccuucaccaucgacaaguga

SEQ ID NO: 19432 - RNA, 1350 nt, Artificial Sequence
  derived and/or modified CDS sequence (AUadapt) from InfluenzaA__ACT15331__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacagcaaggauaacuccauccgcaucggcagccggggcgacguguucgucauccgcgagcccuucaucuccugcagccaccuggaaugccggaccuuuuuccugacgcagggggcccuccugaacgacaagcacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaggaguccgagugcgcgugugucaacggcagcugcuucacggugaugaccgacgggccguccagcggccaggccuccuacaagaucuucaaaauggagaagggcaagguggucaagagcguggagcuggaugcccccaacuaccacuacgaggagugcuccugcuaccccgacgccggggagaucacgugugugugccgggacaacuggcacggcagcaaccgccccugggucuccuucaaccagaaccucgaguaucagaucggguacaucugcagcggcguguucggggacaacccgcggcccaacgacggcaccggcuccugcgggcccguguuucccaacggcgccuacggggucaagggcuucagcuucaaauacgggaacggcguguggaucggccgcaccaaguccaccaacagucgguccggguucgagaugaucugggacccgaacggcuggaccgggaccgacagcagcuucuccgugaagcaggacaucgucgcgaucacggacuggaguggcuacuccgggagcuucgugcagcaccccgagcugaccggccuggacugcauccgccccugcuucugggucgagcucauccggggccgccccaaggaguccaccaucuggaccagcggguccaguaucuccuucugcggcgugaacagcgacacgguguccuggagcuggccggacggggccgagcugcccuucaccaucgacaaguga

SEQ ID NO: 19433 - RNA, 1350 nt, Artificial Sequence
  derived and/or modified CDS sequence (AUadapt) from InfluenzaA__ACT15333__NA
augaaucccaaccaaaagaucaucaccaucggcagcaucugcauggugaucgggaucgucucccugaugcuccagaucggcaacaugaucagcaucugggugucccacagcauccagaccgggaaucagugccagggcgagccgaucuccaacacgaaguuccugaccgaaaaggccguggccagcgucacccuggcggggaacuccagccucugccccaucuccggcugggccguguacaguaaggacaacuccauccgcaucggcagccgcggggacguguucgucauccgggagcccuucaucuccugcagccaucuggagugccggaccuucuuccugacgcagggcgcccuccugaacgacaagcacuccaacgggaccgugaaggaccgcaguccccaccggacccugauguccugcccggugggcgaggcccccagccccuacaacucccgcuucgaaagcgucgccuggagcgcguccgccugucacgacgggaccagcuggcucacgaucggcaucuccggccccgacaacggggccguggccgugcugaaguacaacggcaucaucaccgacaccaucaagaguuggcggaacaacauccugcgcacccaggaguccgagugcgcgugcgucaacgggagcugcuucacggugaugaccgauggcccguccagcggccaggccuccuacaagaucuucaaaauggagaaggggaagguggucaagagcguggagcucgacgcccccaacuaccacuaugaggagugcuccugcuaccccgacgccggcgagaucacgugcgugugccgggacaacuggcaugggagcaaccgccccugggucuccuucaaccaaaaccuggaguaccagaucggcuacaucugcagugggguguucggcgacaacccgcggcccaacgacggcaccggguccugcggccccguggucagcaacggggccuauggcgugaagggguucuccuucaaguacggcaacggcguguggaucgggcgcaccaagagcaccaacucccggagcggcuucgagaugaucugggaucccaacggguggaccggcaccgacagcuccuucagcgggaagcaagacaucgucgcgaucacggacugguccggcuacaguggcuccuucgugcagcacccggagcugaccgggcucgacugcauccgccccugcuucugggucgagcugauccggggccgccccaaggagagcaccaucuggaccuccgggagcuccaucaguuucugcggcgugaacuccgacacggugagcugguccuggcccgacggcgccgagcugccguucaccaucgacaaguga

SEQ ID NO: 19434 - RNA, 1350 nt, Artificial Sequence
  derived and/or modified CDS sequence (AUadapt) from InfluenzaA__ACT15335__NA
augaaucccaaccaaaagaucaucaccaucggcagcaucugcauggugaucgggaucgucucccugaugcuccagaucggcaacaugaucagcaucugggugucccacagcauccagaccgggaaucgcugccaggacgagccgaucuccaacacgaaguuccugaccgagaaggccguggccagcgucacccuggcgggcaacuccagccucugccccaucuccgggugggccguguauagcaaggacaacuccauccggaucggcagccgcggcgacguguucgucauccgggagcccuucaucuccugcagucaccuggagugccgcaccuucuuccugacgcaaggggcccuccugaacgacaagcacuccaacggcaccgugaaggaucggagcccccaccgcacccugauguccugcccggugggggaggcccccagccccuacaacucccgguucgagagcgucgccuggagugcguccgccugccacgacggcaccagcuggcucacgaucgggaucuccggccccgacaacggcgccguggccgugcugaaguacaacgggaucaucaccgauaccaucaagagcuggcgcaacaacaucaugcggacccaggaguccgagugcgcgugcgucaacggcagcugcuuuacggugaugaccgacgggccguccagcggccaggccuccuacaagaucuucaagauggaaaagggcaagguggucaagagcguggagcuggacgcccccaacuaccauuacgaggagugcuccugcuaccccgacgccggggagaucacgugcgugugccgcgacaauuggcacggcagcaaccggcccugggucuccuucaaccagaaccucgaguacaagaucggguacaucuguagcggcaucuucggggacaacccgcgccccaacgacggcaccggcuccugcgggcccgugcugcccaacggcgccuauggggugaagggcuucagcuucaaauacgggaacggcgucuggaucggccggaccaaguccaccaacagccgcuccggguucgagaugaucugggauccgaacggcuggaccgggaccgacagcagcuucuccgugaagcaggacaucguggcgaucacggacuggagcggcuauuccgggagcuucguccagcaccccgagcugaccggccucgacugcauccggcccugcuucuggguggagcugauccgcggccggcccaaggaguccaccaucuggaccagcggguccaguaucuccuucugcggcgucaacggggacacggugagcugguccuggccggacggcgccgagcugcccuucaccaucgacaaguga

SEQ ID NO: 19435 - RNA, 1350 nt, Artificial Sequence
  derived and/or modified CDS sequence (AUadapt) from InfluenzaA__ACT15337__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgaaaaggccguggccagcgucacccuggcgggcaacuccagccucugccccaucuccgggugggccguguacagcaaggauaacuccauccgcaucggcagccggggcgacguguucgucauccgcgagcccuucaucuccugcagccaccuggagugucggaccuucuuccugacgcagggggcccuccugaacgacaagcacuccaacggcaccgugaaggaccgcagcccccaccggacccugauguccuguccggugggggaggcccccagccccuacaacucccgcuucgaaagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaggaguccgagugugcgugcgucaacggcagcugcuucacggugaugaccgacgggccguccagcggccaggccuccuacaagaucuucaaaauggagaagggcaagguggucaagaguguggagcuggacgcccccaacuaccacuacgaggagugcuccugcuaccccgacgccggggagaucacgugugugugccgggacaacuggcacggcagcaaccgccccugggucuccuucaaccaaaaucucgaguaccagaucggguacaucugcagcggcguguucggggacaacccgcggcccaacgacggcaccggcuccugugggcccguguuccccaacggcgccuacggggucaagggcuucagcuucaaguacgggaacggcguguggaucggccgcaccaaguccaccaacagucgguccggguucgagaugaucugggacccgaacggcuggaccgggaccgacagcagcuucuccgugaagcaagacaucgucgcggugacggauuggagcggcuacuccgggagcuucguccagcaccccgagcugaccggccuggacugcauccgccccugcuucuggguggagcucauccggggccgccccaaggaguccaccaucuggaccaguggguccagcaucuccuucugcggcgugaacggggacacggucagcugguccuggccggacggcgccgagcugcccuucaccaucgacaaguga

SEQ ID NO: 19436 - RNA, 1350 nt, Artificial Sequence; identical to SEQ ID NO: 19425
  derived and/or modified CDS sequence (AUadapt) from InfluenzaA__ACT15341__NA

SEQ ID NO: 19437 - RNA, 1350 nt, Artificial Sequence
  derived and/or modified CDS sequence (AUadapt) from InfluenzaA__ACT15344__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgaaaaggccguggccagcgucacccuggcgggcaacuccagccucugccccaucuccgggugggccguguacagcaaggauaacuccauccgcaucggcagccggggcgacguguucgucauccgcgagcccuucaucuccugcagccaccuggagugucggaccuucuuccugacgcagggggcccuccugaacgacaagcacuccaacggcaccgugaaggaccgcagcccccaccggacccugauguccuguccggugggggaggcccccagccccuacaacucccgcuucgaaagcgucgccuggagcgcguccgccugccacgacggcaccaguuggcucacgaucgggaucuccggccccgacaacggcgccguggccgugcugaaguacaacgggaucaucaccgacaccaucaagagcuggcgguccaacaucaugcgcacccaggagagcgagugugcgugcgucaacggcuccugcuucacggugaugaccgacgggccgagcuccggccaggccagcuacaagaucuucaaaauggagaagggcaagguggucaaguccguggagcuggaugcccccaacuaccacuacgaggagugcagcugcuaccccgacgccggggagaucacgugugugugccgggacaacuggcacggcuccaaccgccccugggucagcuucaaccaaaaucucgaguaccagaucggguacaucugcuccggcguguucggggacaacccgcggcccaacgacggcaccggcagcugugggcccguguuccccaacggcgccuacggggucaagggcuucuccuucaaguacgggaacggcguguggaucggccgcaccaagagcaccaacucccggaguggguucgagaugaucugggacccgaacggcuggaccgggaccgacagcuccuucagcgugaagcaagacaucgucgcgaucacggauugguccggcuacagcggguccuucgugcagcaccccgagcugaccggccuggacugcauccgccccugcuucugggucgagcucauccggggccgccccaaggagagcaccaucuggaccuccgggaguuccaucagcuucugcggcgugaacggggacacgguguccuggagcuggccggacggcgccgagcugcccuucaccaucgacaaguga

SEQ ID NO: 19438 - RNA, 1350 nt, Artificial Sequence
  derived and/or modified CDS sequence (AUadapt) from InfluenzaA__ACT15346__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacaguaaggacaacaacauccgcaucggcucccggggcgacguguucgucauccgcgagcccuucaucagcugcucccaucuggagugccggaccuucuuccugacgcagggggcccuccugaacgacaagcacagcaacggcaccgugaaggaucgcagcccccaccggacccugauguccugcccggugggggaggcccccucccccuacaacagccgcuucgaauccgucgccuggagcgcgagugccugccacgacggcaccuccuggcucacgaucgggaucagcggccccgacaacggcgccguggccgugcugaaguacaacgggaucaucaccgauaccaucaaguccuggcggaacaacaucaugcgcacccaggagagcgagugcgcgugcgucaacggcuccugcuucacggugaugaccgaugggccgagcuccggccaggccagcuacaagaucuucaagauggagaagggcaagguggucaaguccguggagcuggacgcccccaacuaccacuaugaggagugcagcugcuaccccgacgccggggagaucacgugcgugugccgggacaauuggcacggcuccaaccgccccugggucagcuucaaccaaaaccucgaguaccagaucggguacaucuguuccggcguguucggggacaacccgcggcccaacgacggcaccggcagcugcgggcccguguuccccaauggcgccuacggggucaagggcuucuccuucaaguacgggaacggcguguggaucggccgcaccaagagcaccaacucccggagcggguuugagaugaucugggacccgaacggcuggaccgggaccgacuccagcuucagcgugaagcaggacaucgucgcgaucacggacugguccggcuauagcggguccuucgugcagcaccccgagcugaccggccuggacugcauccgccccugcuucugggucgagcucauccggggccgccccaaggagagcaccaucuggaccuccgggaguuccaucagcuucugcggcgugaacggggacacgguguccuggagcuggccggacggcgccgagcugcccuucaccaucgacaaguga

SEQ ID NO: 19439 - RNA, 1350 nt, Artificial Sequence
  derived and/or modified CDS sequence (AUadapt) from InfluenzaA__ACT15348__NA
augaaucccaaccaaaagaucaucaccaucggcagcaucugcauggugaucgggaccgucucccugaugcuccagaucggcaacaugaucagcaucugggugucccacagcauccagacggggaaucagugccagggcgagccgaucuccaacaccaaguuccugaccgaaaaggccguggccagcgucacccuggcggggaacuccagccucugccccaucuccggcugggccguguauagcaaggacaacuccauccgcaucggcagccgcggggacguguucgucauccgggagcccuucaucuccugcagucaccuggagugccggacguucuuccugacccagggcgcccuccugaacgacaagcacuccaaugggaccgugaaggaccgcagcccccaccggacccugauguccugcccggugggcgaggcccccagccccuacaacucccgcuuugaaagcgucgccuggagcgcguccgccugccacgacgggacgagcuggcucaccaucggcaucuccggccccgacaacggggccguggccgugcugaaguauaacggcaucaucaccgacaccaucaagagcuggcggaacaacauccugcgcacgcaggaguccgagugcgcgugcgucaaugggagcugcuucaccgugaugaccgacggcccguccagcggccaggccuccuacaagaucuucaaaauggagaaggggaagguggucaagagcguggagcucgaugcccccaacuaccacuacgaggagugcuccugcuaccccgaugccggcgagaucacgugcgugugccgggacaacuggcacgggagcaaccgccccugggucuccuuuaaccaaaaccuggaguaccagaucggcuacaucugcagcgggguguucggcgacaauccgcggcccaacgacggcaccggguccugcggccccguggucagcaacggggccuacggcgugaagggguucuccuuuaaguacggcaacggcguguggaucgggcgcaccaagagcaccaacucccggagcggcuucgagaugaucugggaccccaauggguggaccggcacggacagcuccuucagcgggaagcaagacaucgucgcgaucaccgacugguccggcuacagcggcuccuuugugcagcacccggagcugaccgggcucgacugcauccgccccugcuucugggucgagcugauccggggccgccccaaggagagcaccaucuggacguccgggagcuccaucaguuucugcggcgugaacuccgacaccgugagcugguccuggcccgacggcgccgagcugccguucaccaucgacaaguga

SEQ ID NO: 19440 - RNA, 1350 nt, Artificial Sequence
  derived and/or modified CDS sequence (AUadapt) from InfluenzaA__ACT15350__NA
augaaucccaaccaaaagaucaucaccaucggcagcaucugcauggugaucgggaucgucucccugaugcuccagaucggcaacaugaucagcaucugggugucccacagcauccagaccgggaaccgcugucaggacgagccgaucuccaacacgaaguuccugaccgagaaggccguggccagcgucacccuggcgggcaacuccagccucugccccaucuccgggugggccguguacaguaaggacaacuccauccggaucggcagccgcggcgacguguucgucauccgggagcccuucaucuccugcagccaucuggagugccgcaccuucuuccugacgcaaggggcccuccugaacgacaagcacuccaacggcaccgugaaggaccggaguccccaccgcacccugauguccugcccggugggggaggcccccagccccuacaacucccgguucgagagcgucgccuggagcgcguccgccugucacgacggcaccagcuggcucacgaucgggaucuccggccccgacaacggcgccguggccgugcugaaguacaacgggaucaucaccgacaccaucaagaguuggcgcaacaacaucaugcggacccaggaguccgagugcgcgugcgucaacggcagcugcuucacggugaugaccgaugggccguccagcggccaggccuccuacaagaucuucaagauggaaaagggcaagguggucaagagcguggagcuggacgcccccaacuaccacuaugaggagugcuccugcuaccccgacgccggggagaucacgugcgugugccgcgacaacuggcauggcagcaaccggcccugggucuccuucaaccagaaccucgaguacaagaucggguacaucugcaguggcaucuucggggacaacccgcgccccaacgacggcaccggcuccugcgggcccguguuccccaacggcgccuauggggugaagggcuucagcuucaaauacgggaacggcgucuggaucggccggaccaaguccaccaacagccgcuccggguucgagaugaucugggauccgaacggcuggaccgggaccgacagcagcuucuccgugaagcaggacaucguggcgaucacggacuggagcggcuauuccgggagcuucguccagcaccccgagcugaccggccuggacugcauccggcccugcuucuggguggagcucauccgcggccggcccaaggagcgcaccaucuggaccuccgggagcuccaucaguuucugcggcgucaacggggacacgguguccuggagcuggccggacggcgccgagcugcccuucaccaucgacaaguga

SEQ ID NO: 19441 - RNA, 1350 nt, Artificial Sequence
  derived and/or modified CDS sequence (AUadapt) from InfluenzaA__ACT15352__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacaguaaagacaacuccauccgcaucggcagccggggcgacguguucgucauccgcgagcccuucaucuccugcagccaucuggagugccggaccuucuuccugacgcagggggcccuccugaacgacaagcacuccaacggcaccgugaaggaccgcaguccccaccggacccugauguccugcccggugggggaggcccccagccccuacaacucccgcuucgagagcgucgccuggagcgcguccgccugucacgacggcaccagcuggcucacgaucgggaucuccggccccgacaacggcgccguggccgugcugaaguacaacgggaucaucaccgacaccaucaagaguuggcggaacaacauccugcgcacccaagaguccgagugcgcgugcgucaacggcagcugcuucacggugaugaccgaugggccguccagcggccaggccuccuacaagaucuucaagauggagaagggcaagguggucaagagcguggaacucgacgcccccaacuaccacuaugaggagugcuccugcuaccccgacgccggggagaucacgugcgugugccgggacaacuggcauggcagcaaccgccccugggucuccuucaaccagaaccuggaguaccagaucggguacaucugcaguggcguguucggggacaacccgcggcccaacgacggcaccggcuccugcgggcccguggucagcaacggcgccuauggggugaagggcuucuccuucaaguacgggaacggcguguggaucggccgcaccaagagcaccaacucccggagcggguucgaaaugaucugggaucccaacggcuggaccgggaccgacagcuccuucagcggcaagcaggacaucgucgcgaucacggacugguccggguacaguggcuccuucgugcagcacccggagcugaccggccucgacugcauccgccccugcuucugggucgagcugauccgggggcgccccaaggagagcaccaucuggaccuccggcagcuccaucaguuucugcggggugaacuccgacacggugagcugguccuggcccgacggcgccgagcugccguucaccaucgacaaguga

SEQ ID NO: 19442 - RNA, 1350 nt, Artificial Sequence
  derived and/or modified CDS sequence (AUadapt) from InfluenzaA__ACT15354__NA
augaaucccagccaaaagaucaucaccaucggcuccaucugcauggugaucgggaucgucagccugaugcuccagaucggcaacaugaucuccaucuggaucagccacuccauccagaccgggaaccagugccaggaugagccgaucagcaacacgaaguuccugaccgagaaggccguggccuccgugacccuggcgggcaacagcucccucugccccaucagcgggugggccgucuacuccaaagacaauagcauccgcaucggcucccggggcgacguguucgugauccgcgagcccuucaucagcugcucccaccuggagugccggaccuuuuuccugacgcagggggcccuccugaacgacaagcacagcaacggcaccgucaaggaccgcagcccccaccggacccugauguccuguccggugggggaggcccccucccccuacaacagccgcuucgagagcguggccugguccgcgagcgccugccacgacggcaccuccuggcucacgaucgggaucaguggccccgacaacggcgccgucgccgugcugaaguacaacgggaucaucaccgacaccaucaaguccuggcggaacaacaucaugcgcacccaagagagcgagugugcgugcgugaacggcuccugcuucacggucaugaccgacgggccgagcuccggccaggccagcuacaagaucuucaagauggagaagggcaagguggugaaguccgucgaacuggaugcccccaacuaccacuacgaggagugcagcugcuaccccgacgccggggagaucacgugugugugccgggacaacuggcacggcuccaaccgccccugggugagcuucaaccagaaucucgaguaccagaucggguacaucugcuccggcgucuucggggacaacccgcggcccaacgacggcaccggcagcugugggcccguguuccccaacggcgccuacggggugaagggcuucuccuucaaguacgggaacggcgucuggaucggccgcaccaagagcaccaacucccggaguggguucgaaaugaucugggacccgaacggcuggaccgggaccgacagcuccuucagcgugaagcaggacaucguggcgaucacggauugguccggcuacagcggguccuucguccagcaccccgagcugaccggccuggacugcauccgccccugcuucuggguggagcucauccggggccgccccaaggagagcaccaucuggaccuccgggaguuccaucagcuucugcggcgucaacggggacacgguguccuggagcuggccggacggcgccgagcugcccuucaccaucgacaaguga

SEQ ID NO: 19443 - RNA, 1350 nt, Artificial Sequence
  derived and/or modified CDS sequence (AUadapt) from InfluenzaA__ACT15356__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacagcaaagauaacuccauccgcaucggcagccggggcgacguguucgucauccgcgagcccuucaucuccugcagccaccuggagugccggaccuuuuuccugacgcagggggcccuccugaacgacaagcacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacauccugcgcacccaagaguccgagugcgcgugugucaacggcagcugcuucacggugaugaccgacgggccguccagcggccaggccuccuacaagaucuucaagauggagaagggcaagguggucaagagcguggaacucgaugcccccaacuaccacuacgaggagugcuccugcuaccccgacgccggggagaucacgugugugugccgggacaacuggcacggcagcaaccgccccugggucuccuucaaccagaaccuggaguaucagaucggguacaucugcagcggcguguucggggacaacccgcggcccaacgacggcaccggcuccugcgggcccguguuuagcaacggcgccuacggggucaagggcuucuccuucaaguacgggaacggcguguggaucggccgcaccaagagcaccaauucccggagcggguucgaaaugaucugggaccccaacggcuggaccgggaccgacagcuccuucagcggcaagcaggacaucguggcgaucacggauugguccggguacagcggcuccuucguccagcacccggagcugaccggccucgacugcauccgccccugcuucuggguggagcugauccgggggcgccccaaggagagcaccaucuggaccuccggcaguuccaucagcuucugcggggucaacuccgacacggugagcugguccuggcccgacggcgccgagcugccguucaccaucgacaaguga

SEQ ID NO: 19444 - RNA, 1350 nt, Artificial Sequence
  derived and/or modified CDS sequence (AUadapt) from InfluenzaA__ACT15358__NA
augaaucccaaccaaaagaucaucaccaucggcagcaucugcauggugaucgggaucgucucccugaugcuccagaucggcaacaugaucagcaucugggugucccacagcauccagaccgggaaccgcugucaggacgagccgaucuccaacacgaaguuccugaccgagaaggccguggccagcgucacccuggcgggcaacuccagccucugccccaucuccgggugggccguguacaguaaggacaacuccauccggaucggcagccgcggcgacguguucgucauccgggagcccuucaucuccugcagccaucuggagugccgcaccuucuuccugacgcacggggcccuccugaacgacaagcacuccaacggcaccgugaaggaucggagcccccaccgcacccugauguccugcccggugggggaggcccccagccccuacaacucccgguucgagagcgucgccuggagugcguccgccugccacgacggcaccagcuggcucacgaucgggaucuccggccccgacaacggcgccguggccgugcugaaauacaacgggaucaucaccgauaccaucaagagcuggcgcaacaacaucaugcggacccaggaguccgagugcgcgugcgucaacggcagcugcuuuacggugaugaccgacgggccguccagcggccaggccuccuacaagaucuucaagauggagaagggcaagguggucaagagcguggagcuggacgcccccaacuaccauuacgaggagugcuccugcuaccccgacgccggggagaucacgugcgugugccgcgacaauuggcacggcagcaaccggcccuggaucuccuucaaccaaaaccucgaguacaagaucggguacaucuguagcggcaucuucggggacaacccgcgccccaacgacggcaccggcuccugcgggcccguccugcccaacggcgccuauggggugaagggcuucagcuucaaguacgggaacggcguguggaucggccggaccaaguccaccaacagccgcuccggguucgagaugaucugggauccgaacggcuggaccgggaccgacagcagcuucuccgucaagcaggacaucguggcgaucacggacuggagcggcuauuccgggagcuucgugcagcaccccgagcugaccggccucgacugcauccggcccugcuucugggucgagcugauccgcggccggcccaaggaguccaccaucuggaccagcggguccaguaucuccuucugcggcgugaacggggacacggucagcugguccuggccggacggcgccgagcugcccuucaccaucgacaaguga

SEQ ID NO: 19445 - RNA, 1410 nt, Artificial Sequence; identical to SEQ ID NO: 16729
  derived and/or modified CDS sequence (AUadapt) from InfluenzaA__ACT21515__NA

SEQ ID NO: 19446 - RNA, 1410 nt, Artificial Sequence
  derived and/or modified CDS sequence (AUadapt) from InfluenzaA__ACT21516__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucgccuaccucaccaacaccacgaucgagaaggagaucugccccaagcuggcggaguaccggaacuggucgaagccgcagugcgacaucaccggguucgcccccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacgacaccgugcacgaccgcaccccguaccggacccugcucaugaacgagcugggcguccccuuccaccugggcacgaagcaggucugcguggccuggagcuccucguccugccacgacgggaaggcguggcuccacgugugcgugaccggcgacgagaagaacgccaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggcggacaccaagauccucuucaucgaggagggcaagaucgugcacacgagcacccuguccgggucggcccagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaacgaggugcuguggaccuccaacagcaucgucguguucugcggcaccuccgggaccuacggcacggggagcuggccggacggcgccgacaucaaccugaugcccaucuga

SEQ ID NO: 19447 - RNA, 1410 nt, Artificial Sequence
  derived and/or modified CDS sequence (AUadapt) from InfluenzaA__ACT21517__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucggagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccuggugaugaacgagcucggcgugcccuuccaccugggcacgaagcaggucugcaucgccuggagcuccucguccugccacgacgggaaggccuggcugcacgugugcgugaccggcgacgacaagaacgcgaccgccagcuucaucuacaacgggcgccucgucgacuccaucgugucgugguccaaggagauccugcggacccaggagagcgagugcgugugcaucaacggcacgugcaccgucgugaugaccgacggguccgccucgggcaaggccgacaccaagauccuguucaucgaggagggcaagaucgugcacacgagcacccucuccgggucggcgcagcacgucgaggagugcuccugcuacccccgcuaccccggcgugcggugcgugugccgcgacaacuggaaggggagcaaccggccgaucgucgacaucaacaucaaggacuacuccaucgugucguccuacgugugcagcggccuggccggcgacacgccccgcaagaacgacuccucguccagcucccacugccuggaccccaacaacgaggagggcgggcacggggucaagggcugggccuucgacgacgggaacgacguguggaugggccggaccaucucggagaagcuccgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 19448 - RNA, 1410 nt, Artificial Sequence; identical to SEQ ID NO: 16318
  derived and/or modified CDS sequence (AUadapt) from InfluenzaA__ACT21574__NA

SEQ ID NO: 19449 - RNA, 1410 nt, Artificial Sequence; identical to SEQ ID NO: 16318
  derived and/or modified CDS sequence (AUadapt) from InfluenzaA__ACT21585__NA

SEQ ID NO: 19450 - RNA, 1410 nt, Artificial Sequence; identical to SEQ ID NO: 16318
  derived and/or modified CDS sequence (AUadapt) from InfluenzaA__ACT22011__NA

SEQ ID NO: 19451 - RNA, 1410 nt, Artificial Sequence; identical to SEQ ID NO: 16318
  derived and/or modified CDS sequence (AUadapt) from InfluenzaA__ACT22012__NA

SEQ ID NO: 19452 - RNA, 1410 nt, Artificial Sequence; identical to SEQ ID NO: 16318
  derived and/or modified CDS sequence (AUadapt) from InfluenzaA__ACT22013__NA

SEQ ID NO: 19453 - RNA, 1410 nt, Artificial Sequence; identical to SEQ ID NO: 16318
  derived and/or modified CDS sequence (AUadapt) from InfluenzaA__ACT22014__NA

SEQ ID NO: 19454 - RNA, 1410 nt, Artificial Sequence; identical to SEQ ID NO: 16274
  derived and/or modified CDS sequence (AUadapt) from InfluenzaA__ACT22015__NA

SEQ ID NO: 19455 - RNA, 1410 nt, Artificial Sequence
  derived and/or modified CDS sequence (AUadapt) from InfluenzaA__ACT22016__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19456 - RNA, 1410 nt, Artificial Sequence; identical to SEQ ID NO: 16318
  derived and/or modified CDS sequence (AUadapt) from InfluenzaA__ACT22017__NA

SEQ ID NO: 19457 - RNA, 1410 nt, Artificial Sequence; identical to SEQ ID NO: 16318
  derived and/or modified CDS sequence (AUadapt) from InfluenzaA__ACT22018__NA

SEQ ID NO: 19458 - RNA, 1410 nt, Artificial Sequence; identical to SEQ ID NO: 16274
  derived and/or modified CDS sequence (AUadapt) from InfluenzaA__ACT22506__NA

SEQ ID NO: 19459 - RNA, 1410 nt, Artificial Sequence; identical to SEQ ID NO: 16318
  derived and/or modified CDS sequence (AUadapt) from InfluenzaA__ACT22511__NA

SEQ ID NO: 19460 - RNA, 1410 nt, Artificial Sequence; identical to SEQ ID NO: 16318
  derived and/or modified CDS sequence (AUadapt) from InfluenzaA__ACT33121__NA

SEQ ID NO: 19461 - RNA, 1410 nt, Artificial Sequence; identical to SEQ ID NO: 16318
  derived and/or modified CDS sequence (AUadapt) from InfluenzaA__ACT33124__NA

SEQ ID NO: 19462 - RNA, 1410 nt, Artificial Sequence; identical to SEQ ID NO: 16318
  derived and/or modified CDS sequence (AUadapt) from InfluenzaA__ACT33126__NA

SEQ ID NO: 19463 - RNA, 1410 nt, Artificial Sequence; identical to SEQ ID NO: 16274
  derived and/or modified CDS sequence (AUadapt) from InfluenzaA__ACT35526__NA

SEQ ID NO: 19464 - RNA, 1410 nt, Artificial Sequence; identical to SEQ ID NO: 16318
  derived and/or modified CDS sequence (AUadapt) from InfluenzaA__ACT36507__NA

SEQ ID NO: 19465 - RNA, 1410 nt, Artificial Sequence; identical to SEQ ID NO: 16318
  derived and/or modified CDS sequence (AUadapt) from InfluenzaA__ACT36672__NA

SEQ ID NO: 19466 - RNA, 1410 nt, Artificial Sequence; identical to SEQ ID NO: 16318
  derived and/or modified CDS sequence (AUadapt) from InfluenzaA__ACT36673__NA

SEQ ID NO: 19467 - RNA, 1410 nt, Artificial Sequence; identical to SEQ ID NO: 16318
  derived and/or modified CDS sequence (AUadapt) from InfluenzaA__ACT36674__NA

SEQ ID NO: 19468 - RNA, 1410 nt, Artificial Sequence; identical to SEQ ID NO: 16318
  derived and/or modified CDS sequence (AUadapt) from InfluenzaA__ACT36675__NA

SEQ ID NO: 19469 - RNA, 1410 nt, Artificial Sequence; identical to SEQ ID NO: 16318
  derived and/or modified CDS sequence (AUadapt) from InfluenzaA__ACT36677__NA

SEQ ID NO: 19470 - RNA, 1410 nt, Artificial Sequence
  derived and/or modified CDS sequence (AUadapt) from InfluenzaA__ACT36678__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcgccagagcgucguguccgugaagcuggccggcaacucgucccucugcccggucagcgggugggccaucuacuccaaggacaacagcgugcggaucggcuccaagggcgacguguucgucauccgcgagcccuucaucagcugcagcccccuggagugccggaccuucuuccugacccagggggcccuccugaacgacaagcacuccaacggcaccaucaaggaccgcucccccuaccggacgcugaugucgugcccgaucggggaggugcccucccccuacaacagccgcuucgagagcguggccugguccgcgagcgccugccacgacggcaucaacuggcucaccaucgggaucuccggccccgacaacggcgccgucgccgugcugaaguacaacgggaucaucaccgacaccaucaagagcuggcggaacaacauccugcgcacgcaggaguccgagugcgcgugcgugaacggcucgugcuucaccgucaugaccgacgggccguccaacggccaggccagcuacaagaucuuccggaucgagaagggcaagaucgugaaguccguggagaugaacgcccccaacuaccacuacgaggagugcagcugcuaccccgacuccagcgagaucacgugcgucugccgcgacaacuggcacggguccaaccggcccugggugucguucaaccagaaccucgaguaccagaucggcuacaucugcuccgggaucuucggcgacaacccgcgccccaacgacaagaccgggagcugcggccccguguccagcaacggcgccaacggggucaagggcuucuccuucaaguacgggaacggcguguggaucgggcggaccaagagcaucagcucccgcaacggcuucgagaugaucugggaccccaacggcuggaccgggaccgacaacaacuucucgaucaagcaggacaucgugggcaucaacgagugguccggguacagcggcuccuucguccagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 19471 - RNA, 1410 nt, Artificial Sequence; identical to SEQ ID NO: 16274
  derived and/or modified CDS sequence (AUadapt) from InfluenzaA__ACT36679__NA

SEQ ID NO: 19472 - RNA, 1410 nt, Artificial Sequence; identical to SEQ ID NO: 16318
  derived and/or modified CDS sequence (AUadapt) from InfluenzaA__ACT36680__NA

SEQ ID NO: 19473 - RNA, 1410 nt, Artificial Sequence; identical to SEQ ID NO: 16274
  derived and/or modified CDS sequence (AUadapt) from InfluenzaA__ACT36682__NA

SEQ ID NO: 19474 - RNA, 1410 nt, Artificial Sequence; identical to SEQ ID NO: 16274
  derived and/or modified CDS sequence (AUadapt) from InfluenzaA__ACT36683__NA

SEQ ID NO: 19475 - RNA, 1410 nt, Artificial Sequence; identical to SEQ ID NO: 16318
  derived and/or modified CDS sequence (AUadapt) from InfluenzaA__ACT36684__NA

SEQ ID NO: 19476 - RNA, 1410 nt, Artificial Sequence; identical to SEQ ID NO: 16274
  derived and/or modified CDS sequence (AUadapt) from InfluenzaA__ACT36685__NA

SEQ ID NO: 19477 - RNA, 1410 nt, Artificial Sequence; identical to SEQ ID NO: 16274
  derived and/or modified CDS sequence (AUadapt) from InfluenzaA__ACT36686__NA

SEQ ID NO: 19478 - RNA, 1410 nt, Artificial Sequence; identical to SEQ ID NO: 16274
  derived and/or modified CDS sequence (AUadapt) from InfluenzaA__ACT36687__NA

SEQ ID NO: 19479 - RNA, 1410 nt, Artificial Sequence; identical to SEQ ID NO: 16275
  derived and/or modified CDS sequence (AUadapt) from InfluenzaA__ACT36688__NA

SEQ ID NO: 19480 - RNA, 1410 nt, Artificial Sequence; identical to SEQ ID NO: 16274
  derived and/or modified CDS sequence (AUadapt) from InfluenzaA__ACT36689__NA

SEQ ID NO: 19481 - RNA, 1410 nt, Artificial Sequence; identical to SEQ ID NO: 19170
  derived and/or modified CDS sequence (AUadapt) from InfluenzaA__ACT36690__NA

SEQ ID NO: 19482 - RNA, 1410 nt, Artificial Sequence; identical to SEQ ID NO: 16274
  derived and/or modified CDS sequence (AUadapt) from InfluenzaA__ACT36691__NA

SEQ ID NO: 19483 - RNA, 1410 nt, Artificial Sequence; identical to SEQ ID NO: 19170
  derived and/or modified CDS sequence (AUadapt) from InfluenzaA__ACT36693__NA

SEQ ID NO: 19484 - RNA, 1410 nt, Artificial Sequence; identical to SEQ ID NO: 16318
  derived and/or modified CDS sequence (AUadapt) from InfluenzaA__ACT36694__NA

SEQ ID NO: 19485 - RNA, 1410 nt, Artificial Sequence; identical to SEQ ID NO: 16318
  derived and/or modified CDS sequence (AUadapt) from InfluenzaA__ACT36695__NA

SEQ ID NO: 19486 - RNA, 1410 nt, Artificial Sequence; identical to SEQ ID NO: 16318
  derived and/or modified CDS sequence (AUadapt) from InfluenzaA__ACT52684__NA

SEQ ID NO: 19487 - RNA, 1410 nt, Artificial Sequence; identical to SEQ ID NO: 16274
  derived and/or modified CDS sequence (AUadapt) from InfluenzaA__ACT54608__NA

SEQ ID NO: 19488 - RNA, 1410 nt, Artificial Sequence
  derived and/or modified CDS sequence (AUadapt) from InfluenzaA__ACT66157__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagauccuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19489 - RNA, 1410 nt, Artificial Sequence; identical to SEQ ID NO: 16318
  derived and/or modified CDS sequence (AUadapt) from InfluenzaA__ACT67117__NA

SEQ ID NO: 19490 - RNA, 1410 nt, Artificial Sequence; identical to SEQ ID NO: 16274
  derived and/or modified CDS sequence (AUadapt) from InfluenzaA__ACT67121__NA

SEQ ID NO: 19491 - RNA, 1410 nt, Artificial Sequence; identical to SEQ ID NO: 16318
  derived and/or modified CDS sequence (AUadapt) from InfluenzaA__ACT67240__NA

SEQ ID NO: 19492 - RNA, 1410 nt, Artificial Sequence; identical to SEQ ID NO: 16318
  derived and/or modified CDS sequence (AUadapt) from InfluenzaA__ACT67241__NA

SEQ ID NO: 19493 - RNA, 1410 nt, Artificial Sequence; identical to SEQ ID NO: 16318
  derived and/or modified CDS sequence (AUadapt) from InfluenzaA__ACT67243__NA

SEQ ID NO: 19494 - RNA, 1410 nt, Artificial Sequence
  derived and/or modified CDS sequence (AUadapt) from InfluenzaA__ACT67256__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19495 - RNA, 1410 nt, Artificial Sequence
  derived and/or modified CDS sequence (AUadapt) from InfluenzaA__ACT68161__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaaggccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 19496 - RNA, 1410 nt, Artificial Sequence; identical to SEQ ID NO: 16274
  derived and/or modified CDS sequence (AUadapt) from InfluenzaA__ACT68162__NA

SEQ ID NO: 19497 - RNA, 1410 nt, Artificial Sequence; identical to SEQ ID NO: 16274
  derived and/or modified CDS sequence (AUadapt) from InfluenzaA__ACT68163__NA

SEQ ID NO: 19498 - RNA, 1410 nt, Artificial Sequence; identical to SEQ ID NO: 16274
  derived and/or modified CDS sequence (AUadapt) from InfluenzaA__ACT68164__NA

SEQ ID NO: 19499 - RNA, 1410 nt, Artificial Sequence; identical to SEQ ID NO: 16318
  derived and/or modified CDS sequence (AUadapt) from InfluenzaA__ACT68166__NA

SEQ ID NO: 19500 - RNA, 1410 nt, Artificial Sequence; identical to SEQ ID NO: 16318
  derived and/or modified CDS sequence (AUadapt) from InfluenzaA__ACT68167__NA

SEQ ID NO: 19501 - RNA, 1410 nt, Artificial Sequence; identical to SEQ ID NO: 19170
  derived and/or modified CDS sequence (AUadapt) from InfluenzaA__ACT68168__NA

SEQ ID NO: 19502 - RNA, 1410 nt, Artificial Sequence
  derived and/or modified CDS sequence (AUadapt) from InfluenzaA__ACT68169__NA
augaaccccaaccagaagaucaucaccaucggcucggugugcaugaccaucgggauggccaaccugauccuccagaucggcaacaucaucuccaucuggaucagccacuccauccagcugggggaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgagaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccgggucgugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucagcaucaagcaggacaucgugggcaucuccgaguggucgggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggccgagcugccguucacgaucgacaaguga

SEQ ID NO: 19503 - RNA, 1410 nt, Artificial Sequence; identical to SEQ ID NO: 16274
  derived and/or modified CDS sequence (AUadapt) from InfluenzaA__ACT68171__NA

SEQ ID NO: 19504 - RNA, 1410 nt, Artificial Sequence; identical to SEQ ID NO: 16274
  derived and/or modified CDS sequence (AUadapt) from InfluenzaA__ACT68172__NA

SEQ ID NO: 19505 - RNA, 1410 nt, Artificial Sequence; identical to SEQ ID NO: 16318
  derived and/or modified CDS sequence (AUadapt) from InfluenzaA__ACT68173__NA

SEQ ID NO: 19506 - RNA, 1410 nt, Artificial Sequence; identical to SEQ ID NO: 16318
  derived and/or modified CDS sequence (AUadapt) from InfluenzaA__ACT68174__NA

SEQ ID NO: 19507 - RNA, 1410 nt, Artificial Sequence
  derived and/or modified CDS sequence (AUadapt) from InfluenzaA__ACT68175__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccggcgagaucacgugcgucugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 19508 - RNA, 1410 nt, Artificial Sequence; identical to SEQ ID NO: 16318
  derived and/or modified CDS sequence (AUadapt) from InfluenzaA__ACT68176__NA

SEQ ID NO: 19509 - RNA, 1410 nt, Artificial Sequence; identical to SEQ ID NO: 16318
  derived and/or modified CDS sequence (AUadapt) from InfluenzaA__ACT68177__NA

SEQ ID NO: 19510 - RNA, 1410 nt, Artificial Sequence; identical to SEQ ID NO: 16318
  derived and/or modified CDS sequence (AUadapt) from InfluenzaA__ACT68178__NA

SEQ ID NO: 19511 - RNA, 1410 nt, Artificial Sequence; identical to SEQ ID NO: 19507
  derived and/or modified CDS sequence (AUadapt) from InfluenzaA__ACT68179__NA

SEQ ID NO: 19512 - RNA, 1410 nt, Artificial Sequence; identical to SEQ ID NO: 16318
  derived and/or modified CDS sequence (AUadapt) from InfluenzaA__ACT68180__NA

SEQ ID NO: 19513 - RNA, 1410 nt, Artificial Sequence; identical to SEQ ID NO: 19170
  derived and/or modified CDS sequence (AUadapt) from InfluenzaA__ACT79145__NA

SEQ ID NO: 19514 - RNA, 1410 nt, Artificial Sequence
  derived and/or modified CDS sequence (AUadapt) from InfluenzaA__ACT79155__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucggcggcugggccaucuacagcaaggacaacuccgugcgcaucgggagcaagggcgacguguucgucauccgggagcccuucaucuccugcagccugcuggagugccgcaccuucuuccucacccagggggcccugcugaacgacaagcacuccaacggcaccaucaaggaccggagccccuaccgcacgcucauguccugccccaucggggaggugccgucgcccuacaacucccgguucgagagcguggccuggagcgcguccgccugccacgacggcaucaacuggcugaccaucggcaucagcgggcccgacaacggcgccgucgccgugcugaaguacaacgggaucaucaccgacaccaucaaguccuggcgcaacaacauccuccggacgcaggagagcgagugcgcgugcgugaacggcuccugcuucaccgucaugaccgacggccccucgaacgggcaggccuccuacaagaucuuccgcaucgagaagggcaagaucgucaagagcguggagaugaacgccccgaacuaccacuacgaggagugcuccugcuaccccgacagcuccgagaucacgugcgugugccgggacaacuggcacgggagcaaccgccccuggguguccuucaaccagaaccuggaguaccagaucggcuacaucugcucggggaucuucggcgacaacccccggccgaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggucgggguacuccggcagcuucguccagcaccccgagcugacgggccucgacugcauccgcccgugcuucuggguggagcugauccgggggcgccccaaggagaacaccaucuggaccuccggcagcuccaucagcuucugcggggucaacuccgacaccgugggcuggagcuggcccgacggcgccgagcugcccuucacgaucgacaaguga

SEQ ID NO: 19515 - RNA, 1410 nt, Artificial Sequence; identical to SEQ ID NO: 16274
  derived and/or modified CDS sequence (AUadapt) from InfluenzaA__ACT79165__NA

SEQ ID NO: 19516 - RNA, 1410 nt, Artificial Sequence; identical to SEQ ID NO: 16274
  derived and/or modified CDS sequence (AUadapt) from InfluenzaA__ACT79175__NA

SEQ ID NO: 19517 - RNA, 1410 nt, Artificial Sequence; identical to SEQ ID NO: 16318
  derived and/or modified CDS sequence (AUadapt) from InfluenzaA__ACT79185__NA

SEQ ID NO: 19518 - RNA, 1410 nt, Artificial Sequence; identical to SEQ ID NO: 16318
  derived and/or modified CDS sequence (AUadapt) from InfluenzaA__ACT79622__NA

SEQ ID NO: 19519 - RNA, 1410 nt, Artificial Sequence; identical to SEQ ID NO: 19507
  derived and/or modified CDS sequence (AUadapt) from InfluenzaA__ACT79630__NA

SEQ ID NO: 19520 - RNA, 1410 nt, Artificial Sequence; identical to SEQ ID NO: 16318
  derived and/or modified CDS sequence (AUadapt) from InfluenzaA__ACT83798__NA

SEQ ID NO: 19521 - RNA, 1410 nt, Artificial Sequence; identical to SEQ ID NO: 16318
  derived and/or modified CDS sequence (AUadapt) from InfluenzaA__ACT83808__NA

SEQ ID NO: 19522 - RNA, 1410 nt, Artificial Sequence; identical to SEQ ID NO: 16318
  derived and/or modified CDS sequence (AUadapt) from InfluenzaA__ACT83818__NA

SEQ ID NO: 19523 - RNA, 1410 nt, Artificial Sequence; identical to SEQ ID NO: 16318
  derived and/or modified CDS sequence (AUadapt) from InfluenzaA__ACT83828__NA

SEQ ID NO: 19524 - RNA, 1410 nt, Artificial Sequence; identical to SEQ ID NO: 16318
  derived and/or modified CDS sequence (AUadapt) from InfluenzaA__ACT83838__NA

SEQ ID NO: 19525 - RNA, 1410 nt, Artificial Sequence; identical to SEQ ID NO: 16274
  derived and/or modified CDS sequence (AUadapt) from InfluenzaA__ACT83848__NA

SEQ ID NO: 19526 - RNA, 1410 nt, Artificial Sequence; identical to SEQ ID NO: 16274
  derived and/or modified CDS sequence (AUadapt) from InfluenzaA__ACT83858__NA

SEQ ID NO: 19527 - RNA, 1410 nt, Artificial Sequence; identical to SEQ ID NO: 16318
  derived and/or modified CDS sequence (AUadapt) from InfluenzaA__ACT83868__NA

SEQ ID NO: 19528 - RNA, 1410 nt, Artificial Sequence; identical to SEQ ID NO: 16318
  derived and/or modified CDS sequence (AUadapt) from InfluenzaA__ACT83878__NA

SEQ ID NO: 19529 - RNA, 1410 nt, Artificial Sequence; identical to SEQ ID NO: 16318
  derived and/or modified CDS sequence (AUadapt) from InfluenzaA__ACT86002__NA

SEQ ID NO: 19530 - RNA, 1410 nt, Artificial Sequence; identical to SEQ ID NO: 16318
  derived and/or modified CDS sequence (AUadapt) from InfluenzaA__ACT86012__NA

SEQ ID NO: 19531 - RNA, 1410 nt, Artificial Sequence; identical to SEQ ID NO: 16318
  derived and/or modified CDS sequence (AUadapt) from InfluenzaA__ACT86022__NA

SEQ ID NO: 19532 - RNA, 1410 nt, Artificial Sequence; identical to SEQ ID NO: 16274
  derived and/or modified CDS sequence (AUadapt) from InfluenzaA__ACT86032__NA

SEQ ID NO: 19533 - RNA, 1410 nt, Artificial Sequence; identical to SEQ ID NO: 16318
  derived and/or modified CDS sequence (AUadapt) from InfluenzaA__ACT86042__NA

SEQ ID NO: 19534 - RNA, 1410 nt, Artificial Sequence; identical to SEQ ID NO: 16318
  derived and/or modified CDS sequence (AUadapt) from InfluenzaA__ACT86052__NA

SEQ ID NO: 19535 - RNA, 1410 nt, Artificial Sequence; identical to SEQ ID NO: 16318
  derived and/or modified CDS sequence (AUadapt) from InfluenzaA__ACT86062__NA

SEQ ID NO: 19536 - RNA, 1410 nt, Artificial Sequence; identical to SEQ ID NO: 16318
  derived and/or modified CDS sequence (AUadapt) from InfluenzaA__ACT86072__NA

SEQ ID NO: 19537 - RNA, 1410 nt, Artificial Sequence; identical to SEQ ID NO: 16318
  derived and/or modified CDS sequence (AUadapt) from InfluenzaA__ACT86082__NA

SEQ ID NO: 19538 - RNA, 1410 nt, Artificial Sequence; identical to SEQ ID NO: 16318
  derived and/or modified CDS sequence (AUadapt) from InfluenzaA__ACT86092__NA

SEQ ID NO: 19539 - RNA, 1410 nt, Artificial Sequence; identical to SEQ ID NO: 16318
  derived and/or modified CDS sequence (AUadapt) from InfluenzaA__ACT86102__NA

SEQ ID NO: 19540 - RNA, 1410 nt, Artificial Sequence; identical to SEQ ID NO: 16318
  derived and/or modified CDS sequence (AUadapt) from InfluenzaA__ACT86112__NA

SEQ ID NO: 19541 - RNA, 1410 nt, Artificial Sequence; identical to SEQ ID NO: 16318
  derived and/or modified CDS sequence (AUadapt) from InfluenzaA__ACT86122__NA

SEQ ID NO: 19542 - RNA, 1410 nt, Artificial Sequence; identical to SEQ ID NO: 16318
  derived and/or modified CDS sequence (AUadapt) from InfluenzaA__ACT86132__NA

SEQ ID NO: 19543 - RNA, 1410 nt, Artificial Sequence; identical to SEQ ID NO: 16318
  derived and/or modified CDS sequence (AUadapt) from InfluenzaA__ACT86142__NA

SEQ ID NO: 19544 - RNA, 1410 nt, Artificial Sequence; identical to SEQ ID NO: 16274
  derived and/or modified CDS sequence (AUadapt) from InfluenzaA__ACT97323__NA

SEQ ID NO: 19545 - RNA, 1410 nt, Artificial Sequence; identical to SEQ ID NO: 16318
  derived and/or modified CDS sequence (AUadapt) from InfluenzaA__ACU00934__NA

SEQ ID NO: 19546 - RNA, 1410 nt, Artificial Sequence; identical to SEQ ID NO: 16318
  derived and/or modified CDS sequence (AUadapt) from InfluenzaA__ACU00944__NA

SEQ ID NO: 19547 - RNA, 1410 nt, Artificial Sequence; identical to SEQ ID NO: 19494
  derived and/or modified CDS sequence (AUadapt) from InfluenzaA__ACU00954__NA

SEQ ID NO: 19548 - RNA, 1410 nt, Artificial Sequence
  derived and/or modified CDS sequence (AUadapt) from InfluenzaA__ACU12497__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcccugcgagcccacgaucaucgagcgcaacaucaccgagaucgucuaccucaccaacaccacgaucgagcgggagaucugcccgaagcugguggaguaccgcaacugguccaagccccagugccgggugaccggguucgcgcccuucagcaaggacaacuccauccgccugucggccggcggggacaucugggucacccgggagcccuacguguccugcgacccgggcaagugcuaccaguucgcccucgggcagggcaccacgcugaacaaccgccacagcaacgacaccgugcacgaccggacccccuaccgcacccugcucaugaacgagcugggcguccccuuccaccuggggacgaagcaggucugcaucgccugguccucguccucgugccacgacggcaaggccuggcuccacgugugcgugaccgggcacgacgagaacgcgaccgccuccuucaucuacgacggccggcugguggacagcaucguguccuggucgaagaacauccugcgcacccaggaguccgagugcgucugcaucaacgggacgugcaccguggugaugaccgacggcagcgccuccgagcgggccgacaccaagauccucuucaucgaggagggcaagaucguccacaucucgccccugagcggguccgcgcagcacguggaggagugcucgugcuacccgcgcuaccccggcgugcggugcgucugccgcgacaacuggaagggguccaaccggcccaucguggacaucaacgugaaggacuacucgaucgucuccagcuacgugugcuccggccuggucggcgacacgccccgcaagaacgacucguccagcuccucguacugccggaacccgaacaacgagaaggggucccacggcgugaaggggugggccuucgacgacggcaacgacguguggauggggcgcaccaucggcgaggagcuccggucgggcuacgagaccuucaaggucaucgggggcugguccacccccaacagcaagcugcagacgaaccgccaggugaucguggaccgggggaaccgcuccggcuacucggggaucuucuccgucgagggcaagagcugcaucaaccgcugcuucuacguggagcugauccggggccgcaagcaggagaccaaggugugguggaccucgaacuccaucgucguguucugcgggaccagcggcacguacgggaccggcuccuggcccgacggggccgacaucaaccucaugcccaucuga

SEQ ID NO: 19549 - RNA, 1413 nt, Artificial Sequence; identical to SEQ ID NO: 19034
  derived and/or modified CDS sequence (AUadapt) from InfluenzaA__ACU12508__NA

SEQ ID NO: 19550 - RNA, 1410 nt, Artificial Sequence
  derived and/or modified CDS sequence (AUadapt) from InfluenzaA__ACU12519__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacgagaacgcgaccgccagcuucaucuacaacgggcgccugguggacuccguggucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaccaggagaccgaggugcuguggaccagcaacuccaucgucguguucugcgggaccagcggcacguacgggaccggcuccuggccggacggggccgacaucaaccugaugcccaucuga

SEQ ID NO: 19551 - RNA, 1410 nt, Artificial Sequence
  derived and/or modified CDS sequence (AUadapt) from InfluenzaA__ACU12530__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcaacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 19552 - RNA, 1410 nt, Artificial Sequence
  derived and/or modified CDS sequence (AUadapt) from InfluenzaA__ACU12541__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaaguggcagaucaaccgccaggugaucguggaccggggcaaccggucgggguacuccggcaucuucagcgucgagggcaagucgugcaucaaccgcugcuucuacguggagcugauccgggggcgcaaggaggagaccgaggugcucuggaccuccaacagcaucgucguguucugcggcaccuccgggacguacggcaccgggagcuggccggacggcgccgacaucaaccugaugcccaucuga

SEQ ID NO: 19553 - RNA, 1410 nt, Artificial Sequence
  derived and/or modified CDS sequence (AUadapt) from InfluenzaA__ACU12552__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucgggcuacgugugcuccggccuggugggggacacgccccgcaagaacgacagcuccucguccagccacugcuccgaccccaacaacgaggagggcgggcacggcgucaaggggugggccuucgacgacggcaacgacguguggaugggccggaccaucucggagaagcuccgcuccggguacgagaccuucaaggucaucgagggcuggagcaaccccaacuccaagcugcagaucaaccgccaggugaucguggaccgggggaaccggucgggcuacuccgggaucuucagcgucgagggcaagucgugcaucaaccgcugcuucuacguggagcugauccggggccgcaaggaggagaccgaggugcucuggaccuccaacagcaucgucguguucugcgggaccuccggcacguacgggaccggcagcuggccggacggggccgacaucaaccugaugcccaucuga

SEQ ID NO: 19554 - RNA, 1413 nt, Artificial Sequence
  derived and/or modified CDS sequence (AUadapt) from InfluenzaA__ACU12574__NA
augaaccccaaccagaagaucaucaccaucggcucgaucuccaucgccaucgggaucaucaaccugaugcuccagaucggcaacaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcgcacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucucggugaagcaggacgucguggccaucaccgacugguccggcuacagcgggagcuucgugcagcaccccgagcucacgggccuggacugcauccggcccugcuucugggucgagcuggugcgcggccucccgcgggagaacaccaccaucuggaccuccgggucguccaucagcuucugcggcgucaacuccgacacggccaacuggagcuggcccgacggggccgagcugcccuucaccaucgacaaguga

SEQ ID NO: 19555 - RNA, 1413 nt, Artificial Sequence; identical to SEQ ID NO: 19034
  derived and/or modified CDS sequence (AUadapt) from InfluenzaA__ACU12585__NA

SEQ ID NO: 19556 - RNA, 1413 nt, Artificial Sequence
  derived and/or modified CDS sequence (AUadapt) from InfluenzaA__ACU12596__NA
augaaccccaaccagaagaucaucaccaucggcucgaucuccaucgccaucgggaucaucagccugaugcuccagaucggcuccaucaucagcaucugggccucccacucgauccgcaccgggucccagaacaacacgggcaucugcaaccagcggaucaucaccuacgagaacagcaccugggugaaccacaccuacgucaacaucaacaacacgaacgugguggcgggggaggacaagaaguccgucacccuggccggcaacagcucccugugcucgaucuccggcugggccaucuacaccaaggacaacagcauccgcaucggguccaagggcgacguguucgugauccgggagccguucaucagcugcucccaccucgagugccgcaccuucuuccugacgcagggggcccugcucaacgacaagcacucgaacggcaccgucaaggaccggucccccuaccgcgcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucaccggcacgaucaagagcuggaagaagcagauccugcggacccaggaguccgagugcgugugcaugaacgggucgugcuucaccaucaugaccgacggccccuccaacaaggccgccagcuacaagaucuucaagaucgagaaggggaaggugacgaaguccaucgagcucaacgcccccaacuucuacuacgaggagugcagcugcuacccggacaccggcaucgucaugugcgugugccgcgacaacuggcacggguccaaccggcccugggugucguucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucucggugaagcaggacgucguggccaucaccgacuggagcggguacuccggcagcuucgugcagcaccccgagcucaccggccuggacugcauccgccccugcuucugggucgagcuggugcgggggcucccgcgcgagaacacgaccaucuggaccuccggcucguccaucagcuucugcggggucaacuccgacaccgccaacuggagcuggcccgacggcgccgagcugcccuucacgaucgacaaguga

SEQ ID NO: 19557 - RNA, 1410 nt, Artificial Sequence; identical to SEQ ID NO: 16318
  derived and/or modified CDS sequence (AUadapt) from InfluenzaA__ACU13077__NA

SEQ ID NO: 19558 - RNA, 1410 nt, Artificial Sequence; identical to SEQ ID NO: 16318
  derived and/or modified CDS sequence (AUadapt) from InfluenzaA__ACU13078__NA

SEQ ID NO: 19559 - RNA, 1410 nt, Artificial Sequence; identical to SEQ ID NO: 16318
  derived and/or modified CDS sequence (AUadapt) from InfluenzaA__ACU13079__NA

SEQ ID NO: 19560 - RNA, 1410 nt, Artificial Sequence; identical to SEQ ID NO: 16318
  derived and/or modified CDS sequence (AUadapt) from InfluenzaA__ACU13080__NA

SEQ ID NO: 19561 - RNA, 1410 nt, Artificial Sequence; identical to SEQ ID NO: 16274
  derived and/or modified CDS sequence (AUadapt) from InfluenzaA__ACU13081__NA

SEQ ID NO: 19562 - RNA, 1410 nt, Artificial Sequence; identical to SEQ ID NO: 16318
  derived and/or modified CDS sequence (AUadapt) from InfluenzaA__ACU13082__NA

SEQ ID NO: 19563 - RNA, 1410 nt, Artificial Sequence; identical to SEQ ID NO: 16318
  derived and/or modified CDS sequence (AUadapt) from InfluenzaA__ACU13083__NA

SEQ ID NO: 19564 - RNA, 1410 nt, Artificial Sequence
  derived and/or modified CDS sequence (AUadapt) from InfluenzaA__ACU13084__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacucgucccucugcccggugggcggcugggccaucuacagcaaggacaacuccguccgcaucgggagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacucccgguucgagagcguggccuggagcgcguccgccugccacgacggcaucaacuggcucaccaucggcaucucggggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcaacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucucguucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 19565 - RNA, 1410 nt, Artificial Sequence; identical to SEQ ID NO: 16318
  derived and/or modified CDS sequence (AUadapt) from InfluenzaA__ACU16799__NA

SEQ ID NO: 19566 - RNA, 1410 nt, Artificial Sequence; identical to SEQ ID NO: 16318
  derived and/or modified CDS sequence (AUadapt) from InfluenzaA__ACU16861__NA

SEQ ID NO: 19567 - RNA, 1410 nt, Artificial Sequence; identical to SEQ ID NO: 16318
  derived and/or modified CDS sequence (AUadapt) from InfluenzaA__ACU16934__NA

SEQ ID NO: 19568 - RNA, 1410 nt, Artificial Sequence; identical to SEQ ID NO: 16318
  derived and/or modified CDS sequence (AUadapt) from InfluenzaA__ACU16997__NA

SEQ ID NO: 19569 - RNA, 1410 nt, Artificial Sequence; identical to SEQ ID NO: 16318
  derived and/or modified CDS sequence (AUadapt) from InfluenzaA__ACU17130__NA

SEQ ID NO: 19570 - RNA, 1410 nt, Artificial Sequence; identical to SEQ ID NO: 16318
  derived and/or modified CDS sequence (AUadapt) from InfluenzaA__ACU17191__NA

SEQ ID NO: 19571 - RNA, 1410 nt, Artificial Sequence
  derived and/or modified CDS sequence (AUadapt) from InfluenzaA__ACU17262__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 19572 - RNA, 1410 nt, Artificial Sequence; identical to SEQ ID NO: 16318
  derived and/or modified CDS sequence (AUadapt) from InfluenzaA__ACU17325__NA

SEQ ID NO: 19573 - RNA, 1410 nt, Artificial Sequence; identical to SEQ ID NO: 16318
  derived and/or modified CDS sequence (AUadapt) from InfluenzaA__ACU17393__NA

SEQ ID NO: 19574 - RNA, 1410 nt, Artificial Sequence; identical to SEQ ID NO: 16318
  derived and/or modified CDS sequence (AUadapt) from InfluenzaA__ACU17454__NA

SEQ ID NO: 19575 - RNA, 1410 nt, Artificial Sequence; identical to SEQ ID NO: 16318
  derived and/or modified CDS sequence (AUadapt) from InfluenzaA__ACU17524__NA

SEQ ID NO: 19576 - RNA, 1410 nt, Artificial Sequence; identical to SEQ ID NO: 19494
  derived and/or modified CDS sequence (AUadapt) from InfluenzaA__ACU27043__NA

SEQ ID NO: 19577 - RNA, 1413 nt, Artificial Sequence
  derived and/or modified CDS sequence (AUadapt) from InfluenzaA__ACU27415__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucaccuucgccggcaacuccagccugugcuccaucucgggcugggccaucuacaccaaggacaacuccauccggaucgggagcaagggcgacguguucgugauccgcgagccguucaucuccugcagccaccuggagugccggacguucuuccucacccagggggcccugcugaacgacaagcacuccaacggcaccgucaaggaccgcucgcccuaccgggcccucauguccugcccccugggggaggcgcccagcccguacaacagcaaguucgaguccguggccuggagcgccuccgccugccacgacggcaugggcuggcugaccaucgggaucucgggccccgacaacggggcgguggccguccucaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcugaacgcccccaacuucuacuacgaggagugcuccugcuacccggacaccggcaucgucaugugcgugugccgggacaacuggcacgggagcaaccgccccuggguguccuucaaccagaaccucgacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacucgggcuccuucgugcagcaccccgagcugacgggccucgacugcauccggcccugcuucugggucgagcuggugcgcgggcugccgcgggagaacaccaccaucuggaccagcggcuccagcaucuccuucugcggggucaacagcgacacggccaacugguccuggcccgacggcgccgagcuccccuucaccaucgacaaguga

SEQ ID NO: 19578 - RNA, 1413 nt, Artificial Sequence; identical to SEQ ID NO: 19577
  derived and/or modified CDS sequence (AUadapt) from InfluenzaA__ACU27416__NA

SEQ ID NO: 19579 - RNA, 1410 nt, Artificial Sequence; identical to SEQ ID NO: 16274
  derived and/or modified CDS sequence (AUadapt) from InfluenzaA__ACU29961__NA

SEQ ID NO: 19580 - RNA, 1410 nt, Artificial Sequence
  derived and/or modified CDS sequence (AUadapt) from InfluenzaA__ACU29971__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcucgugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggagcgacggcgccgagcugcccuucacgaucgacaaguga

SEQ ID NO: 19581 - RNA, 1410 nt, Artificial Sequence; identical to SEQ ID NO: 16318
  derived and/or modified CDS sequence (AUadapt) from InfluenzaA__ACU29981__NA

SEQ ID NO: 19582 - RNA, 1410 nt, Artificial Sequence; identical to SEQ ID NO: 16318
  derived and/or modified CDS sequence (AUadapt) from InfluenzaA__ACU29991__NA

SEQ ID NO: 19583 - RNA, 1410 nt, Artificial Sequence; identical to SEQ ID NO: 16318
  derived and/or modified CDS sequence (AUadapt) from InfluenzaA__ACU30001__NA

SEQ ID NO: 19584 - RNA, 1410 nt, Artificial Sequence; identical to SEQ ID NO: 16318
  derived and/or modified CDS sequence (AUadapt) from InfluenzaA__ACU30021__NA

SEQ ID NO: 19585 - RNA, 1410 nt, Artificial Sequence
  derived and/or modified CDS sequence (AUadapt) from InfluenzaA__ACU30085__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugauggggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccaacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 19586 - RNA, 1410 nt, Artificial Sequence; identical to SEQ ID NO: 19564
  derived and/or modified CDS sequence (AUadapt) from InfluenzaA__ACU30095__NA

SEQ ID NO: 19587 - RNA, 1410 nt, Artificial Sequence; identical to SEQ ID NO: 16318
  derived and/or modified CDS sequence (AUadapt) from InfluenzaA__ACU30105__NA

SEQ ID NO: 19588 - RNA, 1410 nt, Artificial Sequence; identical to SEQ ID NO: 16318
  derived and/or modified CDS sequence (AUadapt) from InfluenzaA__ACU30114__NA

SEQ ID NO: 19589 - RNA, 1410 nt, Artificial Sequence; identical to SEQ ID NO: 16318
  derived and/or modified CDS sequence (AUadapt) from InfluenzaA__ACU30123__NA

SEQ ID NO: 19590 - RNA, 1410 nt, Artificial Sequence
  derived and/or modified CDS sequence (AUadapt) from InfluenzaA__ACU31177__NA
augaaccccaaccagaagaucaucaccaucggcucggugugcaugaccaucgggauggccaaccugauccuccagaucggcaacaucaucuccaucuggaucagccaccugauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacucgaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggucggcguccgccugccacgacgggaucagcuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19591 - RNA, 1410 nt, Artificial Sequence; identical to SEQ ID NO: 16318
  derived and/or modified CDS sequence (AUadapt) from InfluenzaA__ACU31178__NA

SEQ ID NO: 19592 - RNA, 1410 nt, Artificial Sequence; identical to SEQ ID NO: 16274
  derived and/or modified CDS sequence (AUadapt) from InfluenzaA__ACU31179__NA

SEQ ID NO: 19593 - RNA, 1410 nt, Artificial Sequence; identical to SEQ ID NO: 16274
  derived and/or modified CDS sequence (AUadapt) from InfluenzaA__ACU31180__NA

SEQ ID NO: 19594 - RNA, 1410 nt, Artificial Sequence; identical to SEQ ID NO: 16274
  derived and/or modified CDS sequence (AUadapt) from InfluenzaA__ACU31181__NA

SEQ ID NO: 19595 - RNA, 1410 nt, Artificial Sequence; identical to SEQ ID NO: 16318
  derived and/or modified CDS sequence (AUadapt) from InfluenzaA__ACU31182__NA

SEQ ID NO: 19596 - RNA, 1410 nt, Artificial Sequence; identical to SEQ ID NO: 19170
  derived and/or modified CDS sequence (AUadapt) from InfluenzaA__ACU31183__NA

SEQ ID NO: 19597 - RNA, 1410 nt, Artificial Sequence; identical to SEQ ID NO: 16318
  derived and/or modified CDS sequence (AUadapt) from InfluenzaA__ACU31184__NA

SEQ ID NO: 19598 - RNA, 1410 nt, Artificial Sequence; identical to SEQ ID NO: 16274
  derived and/or modified CDS sequence (AUadapt) from InfluenzaA__ACU31185__NA

SEQ ID NO: 19599 - RNA, 1410 nt, Artificial Sequence; identical to SEQ ID NO: 16274
  derived and/or modified CDS sequence (AUadapt) from InfluenzaA__ACU31186__NA

SEQ ID NO: 19600 - RNA, 1410 nt, Artificial Sequence; identical to SEQ ID NO: 16274
  derived and/or modified CDS sequence (AUadapt) from InfluenzaA__ACU31187__NA

SEQ ID NO: 19601 - RNA, 1410 nt, Artificial Sequence; identical to SEQ ID NO: 16274
  derived and/or modified CDS sequence (AUadapt) from InfluenzaA__ACU31188__NA

SEQ ID NO: 19602 - RNA, 1350 nt, Artificial Sequence
  derived and/or modified CDS sequence (AUadapt) from InfluenzaA__ACU46645__NA
augaaucccaacaagaagaucaucaccaucggcucgaucugcauggugaccgggauggucucccugaugcuccagaucggcaaccugaucagcaucugggugucccacaguauccacacggggaaccagcacaaggccgagccgaucuccaacaccaaccugcucaccgagaagaccguggccagcgucaagcuggcgggcaacuccagucugugccccaucaacgggugggccguguacuccaaggacaacagcauccgcaucggcuccaagggcgauguguucgucauccgggagcccuucaucagcugcucccaccucgagugccgcacguucuuucugacccagggggcccugcucaacgacaagcacucgaacggcaccgugaaggaccggaguccccaccgcacccugauguccgggccggugggcgaggcccccucccccuacaacagccgguucgaguacgucgccugguccgcgagcgccugucacgaccgcacgagccggcugaccaucgggaucuccggccccgacaacggcgccguggccgugcucaaguacaaugggaucaucaccgacaccaucaagagcuggcgcaacaacauccugcggacgcaggaguccgagugcgcgugcgucaacggcaguugcuucaccgugaugaccgacgggccguccaacggccaggccucgcacaagaucuucaagauggagaagggcaagguggucaaguccguggagcuggaugcccccaacuaccacuacgaggagugcagcuguuaccccgacgccggggagaucacgugcgugugccgcgacaacuggcacggcuccaaucggcccugggucagcuucaaccagaaccucgaguaccagaucggguacaucuguuccggcguguucggggacaacccgcgccccaacgacggcgccggcagcugcgggcccguguccaguaacggcgcguacggggucaagggcuucuccuucaaguacgggaacggcguguggaucggccggaccaagaguaccaacucccgcagcggguucgagaugaucugggaccccaacggcuggaccgagaccgacuccucguuuagcgugaagcaggacaucgucgccaucacggacugguccggguacagcggcuccuucgugcagcauccggagcugaccgggcuggacugcauccggcccugcuucugggucgagcucauccgcggccggcccaaggagagcaccaucuggaccuccggcagcuccaucagcuuuugcggggugaacuccgacacggugggcuggagcuggcccgacggggccgagcugccguucaccaucgacaaguga

SEQ ID NO: 19603 - RNA, 1410 nt, Artificial Sequence
  derived and/or modified CDS sequence (AUadapt) from InfluenzaA__ACU56927__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgacaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19604 - RNA, 1410 nt, Artificial Sequence; identical to SEQ ID NO: 19295
  derived and/or modified CDS sequence (AUadapt) from InfluenzaA__ACU56934__NA

SEQ ID NO: 19605 - RNA, 1410 nt, Artificial Sequence; identical to SEQ ID NO: 16318
  derived and/or modified CDS sequence (AUadapt) from InfluenzaA__ACU64791__NA

SEQ ID NO: 19606 - RNA, 1410 nt, Artificial Sequence
  derived and/or modified CDS sequence (AUadapt) from InfluenzaA__ACU64811__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacucgucccucugcccggugagcggcugggccaucuacuccaaggacaacagcguccgcaucggcuccaagggggacguguucaucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 19607 - RNA, 1410 nt, Artificial Sequence; identical to SEQ ID NO: 18905
  derived and/or modified CDS sequence (AUadapt) from InfluenzaA__ACU79885__NA

SEQ ID NO: 19608 - RNA, 1410 nt, Artificial Sequence; identical to SEQ ID NO: 16337
  derived and/or modified CDS sequence (AUadapt) from InfluenzaA__ACU79896__NA

SEQ ID NO: 19609 - RNA, 1410 nt, Artificial Sequence; identical to SEQ ID NO: 16337
  derived and/or modified CDS sequence (AUadapt) from InfluenzaA__ACU79918__NA

SEQ ID NO: 19610 - RNA, 1410 nt, Artificial Sequence; identical to SEQ ID NO: 16337
  derived and/or modified CDS sequence (AUadapt) from InfluenzaA__ACU79929__NA

SEQ ID NO: 19611 - RNA, 1413 nt, Artificial Sequence
  derived and/or modified CDS sequence (AUadapt) from InfluenzaA__ACU79940__NA
augaaccccaaccagaagaucaucaccaucggcucgaucuccaucgugaucgggaucaucagccugaugcuccagaucggcaacaucaucuccaucugggccucgcacuccauccagaccgggagccagaaccacacgggcaucugcaaccagcgcaucaucaccuacgagaacuccaccugggucaaccacaccuacgugaacaucaacaacacgaacguggucgccgggaaggacaagaccucggugacccuggcgggcaacuccagccugugcuccaucucgggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcccccucgccguacaacagcaaguucgaguccguggcguggucggccuccgccugccacgacggcaugggcuggcucaccaucgggaucagcggccccgacaacggggccgucgcggugcugaaguacaacggcaucaucacggagaccaucaaguccuggaagaagcgcauccugcggacccaggagucggagugcgugugcgucaacggcuccugcuucaccaucaugacggacgggcccagcaacggcgccgccuccuacaagaucuucaagaucgagaaggggaaggugaccaagucgaucgagcucaacgcccccaacucccacuacgaggagugcagcugcuacccggacaccggcaccgugaugugcgucugccgcgacaacuggcacggguccaaccggcccugggugucguucaaccagaaccuggacuaccagaucggcuacaucugcuccggcguguucggggacaacccccgccccaaggacggcgaggggagcugcaacccggucacgguggacggcgccgacggggugaagggcuucuccuaccgguacggcaacggggucuggaucggccgcaccaagucgaaccggcugcgcaagggguucgagaugaucugggaccccaacggcuggaccgacaccgacuccgacuucagcgugaagcaggacguggucgcgaugacggacuggucgggguacuccggcagcuucgugcagcaccccgagcucaccggccuggacugcauccggcccugcuucugggucgagcuggugcgcgggcggccgcgcgagaacaccaccaucuggacguccggcucguccaucagcuucugcggggugaacuccgacaccgccaacuggagcuggcccgacggcgccgagcuccccuucaccaucgacaaguga

SEQ ID NO: 19612 - RNA, 1410 nt, Artificial Sequence
  derived and/or modified CDS sequence (AUadapt) from InfluenzaA__ACU79951__NA
augaaccccaaccagaagaucaucaccaucggcucggugucccugaccaucgagacggucugcuuccucaugcagaucgccauccuggccaccaccgugacccugcacuucaagcagcacgagugcgacucgccggcguccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggccuggagcuccucguccugccacgacgggaaggcguggcugcacgugugcgucaccggcgacgaccgcaacgccaccgccucguucaucuacgacgggcggcucguggacuccaucggcagcuggucccagaacauccugcgcacgcaggagucggagugcgugugcaucaacgggaccugcaccgucgugaugaccgacggcuccgccucgggccgggcggacacgcgcauccuguucaucaaggaggggaagaucgugcacaucagcccccucuccggcucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcucggggcuggucggcgacacgccccggaacgacgacuccagcuccaacucgaacugccgcgaccccaacaacgagcgggggaacccgggcgugaaggggugggccuucgacaacggcgacgacguguggaugggccgcaccaucuccaaggacucgcgguccggguacgagaccuucaaggucaucggcggguggagcacccccaacuccaagucgcaggugaaccgccaggucaucgugggcaacaacaacugguccggguacucgggcaucuucagcguggagggcaaguccugcaucaaccggugcuucuacgucgagcugauccgcgggcgcccccaggagacccgggugugguggaccucgaacuccaucguggucuucugcggcaccagcgggacguacggcaccggguccuggcccgacggcgccaacaucaacuucaugccgaucuga

SEQ ID NO: 19613 - RNA, 1410 nt, Artificial Sequence; identical to SEQ ID NO: 19005
  derived and/or modified CDS sequence (AUadapt) from InfluenzaA__ACU79973__NA

SEQ ID NO: 19614 - RNA, 1413 nt, Artificial Sequence; identical to SEQ ID NO: 19034
  derived and/or modified CDS sequence (AUadapt) from InfluenzaA__ACU79984__NA

SEQ ID NO: 19615 - RNA, 1410 nt, Artificial Sequence; identical to SEQ ID NO: 19001
  derived and/or modified CDS sequence (AUadapt) from InfluenzaA__ACU80006__NA

SEQ ID NO: 19616 - RNA, 1410 nt, Artificial Sequence; identical to SEQ ID NO: 16317
  derived and/or modified CDS sequence (AUadapt) from InfluenzaA__ACU80017__NA

SEQ ID NO: 19617 - RNA, 1413 nt, Artificial Sequence; identical to SEQ ID NO: 19034
  derived and/or modified CDS sequence (AUadapt) from InfluenzaA__ACU80028__NA

SEQ ID NO: 19618 - RNA, 1410 nt, Artificial Sequence; identical to SEQ ID NO: 19001
  derived and/or modified CDS sequence (AUadapt) from InfluenzaA__ACU80039__NA

SEQ ID NO: 19619 - RNA, 1413 nt, Artificial Sequence; identical to SEQ ID NO: 19118
  derived and/or modified CDS sequence (AUadapt) from InfluenzaA__ACU80050__NA

SEQ ID NO: 19620 - RNA, 1410 nt, Artificial Sequence; identical to SEQ ID NO: 19551
  derived and/or modified CDS sequence (AUadapt) from InfluenzaA__ACU80061__NA

SEQ ID NO: 19621 - RNA, 1413 nt, Artificial Sequence; identical to SEQ ID NO: 19034
  derived and/or modified CDS sequence (AUadapt) from InfluenzaA__ACU80072__NA

SEQ ID NO: 19622 - RNA, 1413 nt, Artificial Sequence; identical to SEQ ID NO: 19034
  derived and/or modified CDS sequence (AUadapt) from InfluenzaA__ACU80094__NA

SEQ ID NO: 19623 - RNA, 1410 nt, Artificial Sequence; identical to SEQ ID NO: 19005
  derived and/or modified CDS sequence (AUadapt) from InfluenzaA__ACU80105__NA

SEQ ID NO: 19624 - RNA, 1410 nt, Artificial Sequence; identical to SEQ ID NO: 19005
  derived and/or modified CDS sequence (AUadapt) from InfluenzaA__ACU80127__NA

SEQ ID NO: 19625 - RNA, 1410 nt, Artificial Sequence; identical to SEQ ID NO: 19005
  derived and/or modified CDS sequence (AUadapt) from InfluenzaA__ACU80138__NA

SEQ ID NO: 19626 - RNA, 1410 nt, Artificial Sequence; identical to SEQ ID NO: 19001
  derived and/or modified CDS sequence (AUadapt) from InfluenzaA__ACU80160__NA

SEQ ID NO: 19627 - RNA, 1413 nt, Artificial Sequence; identical to SEQ ID NO: 19034
  derived and/or modified CDS sequence (AUadapt) from InfluenzaA__ACU80171__NA

SEQ ID NO: 19628 - RNA, 1410 nt, Artificial Sequence; identical to SEQ ID NO: 18914
  derived and/or modified CDS sequence (AUadapt) from InfluenzaA__ACU80182__NA

SEQ ID NO: 19629 - RNA, 1410 nt, Artificial Sequence
  derived and/or modified CDS sequence (AUadapt) from InfluenzaA__ACU80193__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacgcaggagucggagugcgucugcaucaacgggaccugcaccguggugaugaccgacggguccgccagcggcaaggccgacacgaagauccucuucaucgaggagggcaagaucguccacaccucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcggccacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcgaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 19630 - RNA, 1410 nt, Artificial Sequence; identical to SEQ ID NO: 18914
  derived and/or modified CDS sequence (AUadapt) from InfluenzaA__ACU80204__NA

SEQ ID NO: 19631 - RNA, 1413 nt, Artificial Sequence
  derived and/or modified CDS sequence (AUadapt) from InfluenzaA__ACU80237__NA
augaaccccaaccagaagaucaucaccaucggcucgaucuccaucgccaucgggaucaucagccugaugcuccagaucggcaacaucaucuccaucugggccucgcacuccauccagaccgggaaccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccuccccguacaacagcaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuuccacuacgaggagugcucgugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugaccguggacggcgcgaacggggucaagggcuucuccuacaaguacgacaacggcguguggaucgggcgcaccaagagcaaccggcugcgcaagggcuucgagaugaucugggaccccaacggguggacgaacaccgacuccgacuucagcgugaagcaggacgucguggccaucaccgacugguccggcuacucggggagcuucgugcagcaccccgagcucacgggccuggacugcauccggcccugcuucugggucgagcuggugcgcggccucccgcgggagaacaccaccaucuggaccuccgggucguccaucagcuucugcggcgucaacuccgacacggccaacuggagcuggcccgacggggccgagcugcccuucaccaucgacaaguga

SEQ ID NO: 19632 - RNA, 1410 nt, Artificial Sequence; identical to SEQ ID NO: 19005
  derived and/or modified CDS sequence (AUadapt) from InfluenzaA__ACU80248__NA

SEQ ID NO: 19633 - RNA, 1410 nt, Artificial Sequence; identical to SEQ ID NO: 19005
  derived and/or modified CDS sequence (AUadapt) from InfluenzaA__ACU80259__NA

SEQ ID NO: 19634 - RNA, 1413 nt, Artificial Sequence
  derived and/or modified CDS sequence (AUadapt) from InfluenzaA__ACU80270__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuuccacuacgaggagugcuccugcuacccggacaccagcaucgucaugugcgugugccgggacaacuggcacggcuccaaccgccccugggugucguucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacggggcuggacugcauccggcccugcuucugggucgagcuggugcgcggccucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 19635 - RNA, 1413 nt, Artificial Sequence
  derived and/or modified CDS sequence (AUadapt) from InfluenzaA__ACU80281__NA
augaaccagaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagcccuucaucuccugcagccaccucgagugccggacguucuuccugacccagggggcccugcucaacgacaagcacuccaacggcaccgucaaggaccgcagcccguaccgggcccugauguccugcccccugggggaggcgcccucgcccuacaacagcaaguucgaguccguggccuggagcgccuccgccugccacgacggcaugggcuggcucaccaucgggaucucgggcccggacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuaccccgacaccggcaucgucaugugcgugugccgggacaacuggcacgggagcaaccgcccguggguguccuucaaccagaaccuggacuaccagaucggcuacaucugcucgggcgucuucggggacaacccccggcccgaggacggcgagggguccugcaaccccgugaccguggacggcgcgaacggggucaagggcuucagcuacaaguacgacaacggcguguggaucgggcgcacgaaguccaaccggcugcgcaagggcuucgagaugaucugggacccgaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccccgggagaacaccaccaucuggaccucgggguccagcaucuccuucugcggcgucaacagcgacacggccaacugguccuggccggacggggccgagcugcccuucaccaucgacaaguga

SEQ ID NO: 19636 - RNA, 1410 nt, Artificial Sequence
  derived and/or modified CDS sequence (AUadapt) from InfluenzaA__ACU80303__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcaucguguccuggucgaaggagauccugcgcacccaggaguccgagugcgucugcaucaacggcacgugcaccguggugaugaccgacgggagcgccucgggcaaggccgacaccaagauccucuucaucgaggagggcaagaucguccacacguccacccugagcggguccgcgcagcacguggaggagugcucgugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccagcuccucgcacugccucgaccccaacaacgaggagggcgggaacggggugaagggcugggccuucgacgacgggaacgacgucuggaugggccgcaccaucuccgagaagucccggcugggcuacgagacguucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcucauccgcggccggaaggaggagaccgaggugcuguggaccagcaacuccaucguggucuucugcggcaccagcgggacguacggcaccggguccuggcccgacggcgccgacaucaaccugaugccgaucuga

SEQ ID NO: 19637 - RNA, 1410 nt, Artificial Sequence; identical to SEQ ID NO: 19005
  derived and/or modified CDS sequence (AUadapt) from InfluenzaA__ACU80314__NA

SEQ ID NO: 19638 - RNA, 1410 nt, Artificial Sequence; identical to SEQ ID NO: 19005
  derived and/or modified CDS sequence (AUadapt) from InfluenzaA__ACU80325__NA

SEQ ID NO: 19639 - RNA, 1410 nt, Artificial Sequence; identical to SEQ ID NO: 19001
  derived and/or modified CDS sequence (AUadapt) from InfluenzaA__ACU80336__NA

SEQ ID NO: 19640 - RNA, 1410 nt, Artificial Sequence; identical to SEQ ID NO: 19005
  derived and/or modified CDS sequence (AUadapt) from InfluenzaA__ACU80347__NA

SEQ ID NO: 19641 - RNA, 1410 nt, Artificial Sequence; identical to SEQ ID NO: 19005
  derived and/or modified CDS sequence (AUadapt) from InfluenzaA__ACU80358__NA

SEQ ID NO: 19642 - RNA, 1410 nt, Artificial Sequence; identical to SEQ ID NO: 19005
  derived and/or modified CDS sequence (AUadapt) from InfluenzaA__ACU80369__NA

SEQ ID NO: 19643 - RNA, 1410 nt, Artificial Sequence; identical to SEQ ID NO: 19005
  derived and/or modified CDS sequence (AUadapt) from InfluenzaA__ACU80380__NA

SEQ ID NO: 19644 - RNA, 1410 nt, Artificial Sequence
  derived and/or modified CDS sequence (AUadapt) from InfluenzaA__ACU80391__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccaucaucgagaaggagaucugccccaagcuggccgaguaccggaacugguccaagccccagugcgacaucacgggguucgcgccguucagcaaggacaacuccauccgccugagcgccggcggggacaucugggucacccgggagcccuacguguccugcgaccccgacaagugcuaccaguucgcccucggccaggggaccacccugaacaacgugcacucgaacaacacgguccgcgaccggacccccuaccgcacccugcucaugaacgagcugggcgugccguuccaccugggcaccaagcaggucugcaucgccugguccagcuccucgugccacgacgggaaggccuggcuccacgugugcaucacgggcgacgacaagaacgcgaccgccuccuucaucuacaacgggcggcugguggacagcaucguguccuggagcaaggagauccugcgcacccaggaguccgagugcgucugcaucaacgggaccugcacgguggugaugaccgacgggucggccagcggcaaggccgacaccaagauccucuucaucgaggagggcaagaucguccacaccuccacgcugucgggguccgcgcagcacguggaggagugcagcugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccucguccagccacugccucgaccccaacaacgaggagggcggccacggggugaagggcugggccuucgacgacgggaacgacgucuggaugggccgcaccaucuccgagaagucccggcugggcuacgagaccuucaaggugaucgagggguggagcaaccccaagucgaagcugcagaucaaccgccaggucaucguggaccggggcaaccgcuccggguacagcggcaucuucucgguggaggggaaguccugcaucaaccggugcuucuacgucgagcucauccgcggccggaaggaggagacggaggugcuguggaccagcaacuccaucguggucuucugcggcaccagcgggaccuacggcacgggguccuggcccgacggcgccgacaucaaccugaugccgaucuga

SEQ ID NO: 19645 - RNA, 1410 nt, Artificial Sequence; identical to SEQ ID NO: 19001
  derived and/or modified CDS sequence (AUadapt) from InfluenzaA__ACU80402__NA

SEQ ID NO: 19646 - RNA, 1413 nt, Artificial Sequence; identical to SEQ ID NO: 19034
  derived and/or modified CDS sequence (AUadapt) from InfluenzaA__ACU80413__NA

SEQ ID NO: 19647 - RNA, 1410 nt, Artificial Sequence; identical to SEQ ID NO: 19005
  derived and/or modified CDS sequence (AUadapt) from InfluenzaA__ACU80427__NA

SEQ ID NO: 19648 - RNA, 1410 nt, Artificial Sequence; identical to SEQ ID NO: 19005
  derived and/or modified CDS sequence (AUadapt) from InfluenzaA__ACU80438__NA

SEQ ID NO: 19649 - RNA, 1410 nt, Artificial Sequence; identical to SEQ ID NO: 19001
  derived and/or modified CDS sequence (AUadapt) from InfluenzaA__ACU80461__NA

SEQ ID NO: 19650 - RNA, 1410 nt, Artificial Sequence; identical to SEQ ID NO: 19005
  derived and/or modified CDS sequence (AUadapt) from InfluenzaA__ACU80603__NA

SEQ ID NO: 19651 - RNA, 1410 nt, Artificial Sequence; identical to SEQ ID NO: 19005
  derived and/or modified CDS sequence (AUadapt) from InfluenzaA__ACU80614__NA

SEQ ID NO: 19652 - RNA, 1410 nt, Artificial Sequence; identical to SEQ ID NO: 19005
  derived and/or modified CDS sequence (AUadapt) from InfluenzaA__ACU80625__NA

SEQ ID NO: 19653 - RNA, 1410 nt, Artificial Sequence; identical to SEQ ID NO: 19001
  derived and/or modified CDS sequence (AUadapt) from InfluenzaA__ACU80636__NA

SEQ ID NO: 19654 - RNA, 1410 nt, Artificial Sequence
  derived and/or modified CDS sequence (AUadapt) from InfluenzaA__ACU80647__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacgacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcgaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccaucuga

SEQ ID NO: 19655 - RNA, 1410 nt, Artificial Sequence
  derived and/or modified CDS sequence (AUadapt) from InfluenzaA__ACU80658__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccaagaucaucgagcgcaacaucacggagaucguguaccucaccaacaccaccaucgagaaggagaucugccccaagcuggccgaguaccggaacuggucgaagccgcagugcgacaucacgggguucgcgcccuucuccaaggacaacagcauccgccuguccgccggcggggacaucugggucacccgggagcccuacgugucgugcgaccccgacaagugcuaccaguucgcccucggccaggggaccacccugaacaacgugcacuccaacgacacgguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 19656 - RNA, 1410 nt, Artificial Sequence; identical to SEQ ID NO: 18914
  derived and/or modified CDS sequence (AUadapt) from InfluenzaA__ACU80669__NA

SEQ ID NO: 19657 - RNA, 1410 nt, Artificial Sequence; identical to SEQ ID NO: 19001
  derived and/or modified CDS sequence (AUadapt) from InfluenzaA__ACU80691__NA

SEQ ID NO: 19658 - RNA, 1410 nt, Artificial Sequence; identical to SEQ ID NO: 19005
  derived and/or modified CDS sequence (AUadapt) from InfluenzaA__ACU80702__NA

SEQ ID NO: 19659 - RNA, 1410 nt, Artificial Sequence; identical to SEQ ID NO: 19005
  derived and/or modified CDS sequence (AUadapt) from InfluenzaA__ACU80713__NA

SEQ ID NO: 19660 - RNA, 1410 nt, Artificial Sequence; identical to SEQ ID NO: 19001
  derived and/or modified CDS sequence (AUadapt) from InfluenzaA__ACU80724__NA

SEQ ID NO: 19661 - RNA, 1410 nt, Artificial Sequence; identical to SEQ ID NO: 18914
  derived and/or modified CDS sequence (AUadapt) from InfluenzaA__ACU80735__NA

SEQ ID NO: 19662 - RNA, 1410 nt, Artificial Sequence; identical to SEQ ID NO: 19001
  derived and/or modified CDS sequence (AUadapt) from InfluenzaA__ACU80746__NA

SEQ ID NO: 19663 - RNA, 1410 nt, Artificial Sequence
  derived and/or modified CDS sequence (AUadapt) from InfluenzaA__ACU80757__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagguggucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacgacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 19664 - RNA, 1410 nt, Artificial Sequence; identical to SEQ ID NO: 19629
  derived and/or modified CDS sequence (AUadapt) from InfluenzaA__ACU80768__NA

SEQ ID NO: 19665 - RNA, 1410 nt, Artificial Sequence; identical to SEQ ID NO: 19001
  derived and/or modified CDS sequence (AUadapt) from InfluenzaA__ACU80779__NA

SEQ ID NO: 19666 - RNA, 1410 nt, Artificial Sequence; identical to SEQ ID NO: 18914
  derived and/or modified CDS sequence (AUadapt) from InfluenzaA__ACU80790__NA

SEQ ID NO: 19667 - RNA, 1410 nt, Artificial Sequence; identical to SEQ ID NO: 19001
  derived and/or modified CDS sequence (AUadapt) from InfluenzaA__ACU80801__NA

SEQ ID NO: 19668 - RNA, 1410 nt, Artificial Sequence
  derived and/or modified CDS sequence (AUadapt) from InfluenzaA__ACU81106__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaacucguccggguacagcggcaucuucucggucgaggggaaguccugcaucaaccgcugcuucuacguggagcucauccggggccgcaaggaggagaccgaggugcuguggaccagcaacuccaucgucguguucugcggcaccagcgggacguacggcaccggguccuggccggacggcgccgacaucaaccugaugcccaucuga

SEQ ID NO: 19669 - RNA, 1410 nt, Artificial Sequence; identical to SEQ ID NO: 19295
  derived and/or modified CDS sequence (AUadapt) from InfluenzaA__ACU87265__NA

SEQ ID NO: 19670 - RNA, 1410 nt, Artificial Sequence; identical to SEQ ID NO: 16318
  derived and/or modified CDS sequence (AUadapt) from InfluenzaA__ACU87273__NA

SEQ ID NO: 19671 - RNA, 1410 nt, Artificial Sequence; identical to SEQ ID NO: 16318
  derived and/or modified CDS sequence (AUadapt) from InfluenzaA__ACV04231__NA

SEQ ID NO: 19672 - RNA, 1410 nt, Artificial Sequence; identical to SEQ ID NO: 16318
  derived and/or modified CDS sequence (AUadapt) from InfluenzaA__ACV04241__NA

SEQ ID NO: 19673 - RNA, 1410 nt, Artificial Sequence; identical to SEQ ID NO: 16318
  derived and/or modified CDS sequence (AUadapt) from InfluenzaA__ACV04251__NA

SEQ ID NO: 19674 - RNA, 1410 nt, Artificial Sequence; identical to SEQ ID NO: 16318
  derived and/or modified CDS sequence (AUadapt) from InfluenzaA__ACV04261__NA

SEQ ID NO: 19675 - RNA, 1410 nt, Artificial Sequence; identical to SEQ ID NO: 16318
  derived and/or modified CDS sequence (AUadapt) from InfluenzaA__ACV04271__NA

SEQ ID NO: 19676 - RNA, 1410 nt, Artificial Sequence
  derived and/or modified CDS sequence (AUadapt) from InfluenzaA__ACV04281__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucggcaacacgaacuucgccgcggggcaguccgucgugagcgugaagcuggccggcaacuccucgcucugcccggucuccggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacucccgguucgagagcguggccuggagcgcguccgccugccacgacggcaucaacuggcucaccaucggcaucucggggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcgacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucucguucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 19677 - RNA, 1410 nt, Artificial Sequence; identical to SEQ ID NO: 16318
  derived and/or modified CDS sequence (AUadapt) from InfluenzaA__ACV04291__NA

SEQ ID NO: 19678 - RNA, 1410 nt, Artificial Sequence; identical to SEQ ID NO: 16318
  derived and/or modified CDS sequence (AUadapt) from InfluenzaA__ACV04301__NA

SEQ ID NO: 19679 - RNA, 1410 nt, Artificial Sequence; identical to SEQ ID NO: 16318
  derived and/or modified CDS sequence (AUadapt) from InfluenzaA__ACV04321__NA

SEQ ID NO: 19680 - RNA, 1410 nt, Artificial Sequence; identical to SEQ ID NO: 16318
  derived and/or modified CDS sequence (AUadapt) from InfluenzaA__ACV04331__NA

SEQ ID NO: 19681 - RNA, 1410 nt, Artificial Sequence; identical to SEQ ID NO: 16318
  derived and/or modified CDS sequence (AUadapt) from InfluenzaA__ACV04341__NA

SEQ ID NO: 19682 - RNA, 1410 nt, Artificial Sequence; identical to SEQ ID NO: 16318
  derived and/or modified CDS sequence (AUadapt) from InfluenzaA__ACV04351__NA

SEQ ID NO: 19683 - RNA, 1410 nt, Artificial Sequence; identical to SEQ ID NO: 16318
  derived and/or modified CDS sequence (AUadapt) from InfluenzaA__ACV04361__NA

SEQ ID NO: 19684 - RNA, 1410 nt, Artificial Sequence; identical to SEQ ID NO: 16318
  derived and/or modified CDS sequence (AUadapt) from InfluenzaA__ACV04371__NA

SEQ ID NO: 19685 - RNA, 1410 nt, Artificial Sequence; identical to SEQ ID NO: 16318
  derived and/or modified CDS sequence (AUadapt) from InfluenzaA__ACV04381__NA

SEQ ID NO: 19686 - RNA, 1410 nt, Artificial Sequence; identical to SEQ ID NO: 16318
  derived and/or modified CDS sequence (AUadapt) from InfluenzaA__ACV04391__NA

SEQ ID NO: 19687 - RNA, 1410 nt, Artificial Sequence; identical to SEQ ID NO: 16318
  derived and/or modified CDS sequence (AUadapt) from InfluenzaA__ACV04401__NA

SEQ ID NO: 19688 - RNA, 1410 nt, Artificial Sequence; identical to SEQ ID NO: 16274
  derived and/or modified CDS sequence (AUadapt) from InfluenzaA__ACV04411__NA

SEQ ID NO: 19689 - RNA, 1410 nt, Artificial Sequence; identical to SEQ ID NO: 16318
  derived and/or modified CDS sequence (AUadapt) from InfluenzaA__ACV04492__NA

SEQ ID NO: 19690 - RNA, 1410 nt, Artificial Sequence; identical to SEQ ID NO: 16318
  derived and/or modified CDS sequence (AUadapt) from InfluenzaA__ACV04502__NA

SEQ ID NO: 19691 - RNA, 1410 nt, Artificial Sequence; identical to SEQ ID NO: 16274
  derived and/or modified CDS sequence (AUadapt) from InfluenzaA__ACV04512__NA

SEQ ID NO: 19692 - RNA, 1410 nt, Artificial Sequence
  derived and/or modified CDS sequence (AUadapt) from InfluenzaA__ACV04522__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggcaagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19693 - RNA, 1410 nt, Artificial Sequence; identical to SEQ ID NO: 16318
  derived and/or modified CDS sequence (AUadapt) from InfluenzaA__ACV04532__NA

SEQ ID NO: 19694 - RNA, 1410 nt, Artificial Sequence; identical to SEQ ID NO: 16318
  derived and/or modified CDS sequence (AUadapt) from InfluenzaA__ACV04542__NA

SEQ ID NO: 19695 - RNA, 1410 nt, Artificial Sequence; identical to SEQ ID NO: 16318
  derived and/or modified CDS sequence (AUadapt) from InfluenzaA__ACV04552__NA

SEQ ID NO: 19696 - RNA, 1410 nt, Artificial Sequence; identical to SEQ ID NO: 16318
  derived and/or modified CDS sequence (AUadapt) from InfluenzaA__ACV04562__NA

SEQ ID NO: 19697 - RNA, 1410 nt, Artificial Sequence; identical to SEQ ID NO: 16274
  derived and/or modified CDS sequence (AUadapt) from InfluenzaA__ACV04572__NA

SEQ ID NO: 19698 - RNA, 1410 nt, Artificial Sequence; identical to SEQ ID NO: 16318
  derived and/or modified CDS sequence (AUadapt) from InfluenzaA__ACV04582__NA

SEQ ID NO: 19699 - RNA, 1410 nt, Artificial Sequence
  derived and/or modified CDS sequence (AUadapt) from InfluenzaA__ACV04758__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucccccucggagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcugaccaucggcaucagcggccccgacaacggggccguggccguccucaaguacaacggcaucaucaccgacaccaucaaguccuggcgcaacaacauccugcggacgcaggagagcgagugcgcgugcgugaacggguccugcuucaccgugaugaccgacggcccgagcaacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcucacgggccuggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 19700 - RNA, 1410 nt, Artificial Sequence; identical to SEQ ID NO: 16274
  derived and/or modified CDS sequence (AUadapt) from InfluenzaA__ACV33087__NA

SEQ ID NO: 19701 - RNA, 1410 nt, Artificial Sequence; identical to SEQ ID NO: 16318
  derived and/or modified CDS sequence (AUadapt) from InfluenzaA__ACV33107__NA

SEQ ID NO: 19702 - RNA, 1410 nt, Artificial Sequence; identical to SEQ ID NO: 16318
  derived and/or modified CDS sequence (AUadapt) from InfluenzaA__ACV33117__NA

SEQ ID NO: 19703 - RNA, 1410 nt, Artificial Sequence; identical to SEQ ID NO: 16318
  derived and/or modified CDS sequence (AUadapt) from InfluenzaA__ACV33127__NA

SEQ ID NO: 19704 - RNA, 1410 nt, Artificial Sequence; identical to SEQ ID NO: 16318
  derived and/or modified CDS sequence (AUadapt) from InfluenzaA__ACV33137__NA

SEQ ID NO: 19705 - RNA, 1410 nt, Artificial Sequence; identical to SEQ ID NO: 16318
  derived and/or modified CDS sequence (AUadapt) from InfluenzaA__ACV33147__NA

SEQ ID NO: 19706 - RNA, 1410 nt, Artificial Sequence
  derived and/or modified CDS sequence (AUadapt) from InfluenzaA__ACV33157__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccggucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 19707 - RNA, 1410 nt, Artificial Sequence
  derived and/or modified CDS sequence (AUadapt) from InfluenzaA__ACV33167__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgacugguccuggcccgacggggccgagcugccguucacgaucgacaaguga

SEQ ID NO: 19708 - RNA, 1410 nt, Artificial Sequence; identical to SEQ ID NO: 16318
  derived and/or modified CDS sequence (AUadapt) from InfluenzaA__ACV33177__NA

SEQ ID NO: 19709 - RNA, 1410 nt, Artificial Sequence
  derived and/or modified CDS sequence (AUadapt) from InfluenzaA__ACV41993__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagaucugcaaccagagcgucaucacguacgagaacaacaccugggugaaccagaccuacgugaacaucuccaacaccaacuucgccgcgggccagagcgucguguccgugaagcuggccgggaacucgucccucugcccggucggcggcugggccaucuacagcaaggacaacuccgugcgcaucgggagcaagggcgacguguucgucauccgggagcccuucaucuccugcagcccccuggagugccgcacguucuuccugacccagggggcccuccugaacgacaagcacuccaacggcaccaucaaggaccggagccccuaccgcacccugauguccugcccgaucggggaggugcccucgcccuacaacucccgguucgagagcguggccuggagcgcguccgccugccacgacggcaucaacuggcucacgaucggcaucagcgggcccgacaacggcgccgucgccgugcugaaguacaacgggaucaucaccgacaccaucaaguccuggcgcaacaacauccugcggacccaggagagcgagugcgcgugcgugaacggcuccugcuucacggucaugaccgacggcccgucgaacgggcaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcucggggaucuucggcgacaacccgcggcccaacgacaagaccggcuccugcgggcccgugagcuccaacggcgccaacggggucaagggcuucagcuucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggucgggguacuccggcagcuucguccagcacccggagcugaccggccuggacugcauccgccccugcuucuggguggagcucauccgggggcgccccaaggagaacacgaucuggaccuccggcagcuccaucagcuucugcggggucaacuccgacaccgugggcuggagcuggcccgacggcgccgagcugccguucaccaucgacaaguga

SEQ ID NO: 19710 - RNA, 1410 nt, Artificial Sequence; identical to SEQ ID NO: 16318
  derived and/or modified CDS sequence (AUadapt) from InfluenzaA__ACV42010__NA

SEQ ID NO: 19711 - RNA, 1410 nt, Artificial Sequence; identical to SEQ ID NO: 16318
  derived and/or modified CDS sequence (AUadapt) from InfluenzaA__ACV42020__NA

SEQ ID NO: 19712 - RNA, 1410 nt, Artificial Sequence; identical to SEQ ID NO: 18905
  derived and/or modified CDS sequence (AUadapt) from InfluenzaA__ACV49504__NA

SEQ ID NO: 19713 - RNA, 1362 nt, Artificial Sequence
  derived and/or modified CDS sequence (AUadapt) from InfluenzaA__ACV49537__NA
augaaucccaaccagaagaucaucaccaucggcucgaucugcaugguggucgggaucaucucccugauccuccagaucggcaacaucaucagcaucuggaucucccacagcauccagaccgggaaucagaaccacacgggcaucugcaaccaggggaucaucaccuacaacgugguggccggccaggacuccaccagugucauccugaccggcaacuccagccugugcccgauccgcgggugggccauccacuccaaggacaacggcauccggaucgggagcaagggcgacguguuugugauccgcgagcccuucaucuccugcagccaccucgagugccggacguucuuccugacccagggggcgcugcucaaugacaagcacuccaacggcgccgucaaggaccgcagccccuaccgggcccugauguccugccccgugggcgaggccccgagucccuacaacucccgcuucgagagcguggccugguccgcgagcgccugccacgacgggaugggcuggcugaccaucgggaucaguggccccgacaacggcgccgucgccgugcucaaguacaacgggaucaucaccgagacgaucaaguccuggcggaagaagauccugcgcacccaggagagcgagugcacgugcgugaauggcuccugcuucaccaucaugaccgacgggcccucggacggccuggcguccuacaagaucuucaagaucgagaaggggaaggucaccaagagcaucgagcucaaugccccgaacucccacuacgaggagugcagcugcuaccccgauaccggcaaggugaugugcgugugccgggacaacuggcacggcuccaaccgccccugggucagcuuugaccagaaccuggacuaccagaucggguacaucugcuccggcguguucggggacaauccccggccgaaggacggcaccgggagcugcggccccguguccgccgacggcgccaacggggucaagggcuucagcuaucgcuacgggaacggcguguggaucgggcggacgaaguccgacagcucccgccacggcuucgagaugaucugggaccccaauggcuggaccgagaccgacagccgguucuccgugcgccaggacgucguggccaugaccgaccggagcggguacagcggcuccuuugugcagcaccccgagcugacggggcucgacugcaugcgcccgugcuucugggucgagcugauccggggccgccccgaggagaagaccaucuggaccagcggcuccaucaucagcuuuugcggggugaacuccgacaccgucgacuggagcuggcccgacggcgcggagcugcccuucacgaucgacaaguga

SEQ ID NO: 19714 - RNA, 1362 nt, Artificial Sequence
  derived and/or modified CDS sequence (AUadapt) from InfluenzaA__ACV49559__NA
augaaucccaaccaaaagaucaucaccaucggcagcaucugcaugguggucgggaucaucucccugauccuccagaucggcaacaucaucagcaucuggaucucccacagcauccaggccggguccaguaccugggugaaccagacguacgugaacaucuccaacaccaacgucguggccggccaggacgcgaccagcgugauccugaccgggaacuccagucugugcccgauccgcggcugggccaucuacuccaaggacaacggcauccggaucgggagcaagggcgacaucuucgucauccgcgagcccuucaucuccuguagccaccucgagugccgggccuucuuccugacgcagggggcccugcucaacgacaagcauuccaacggcaccgugaaggaccgcagccccuaccgggcccugauguccugccccgugggggaggcgccgagccccuacaacucccgcuuugagagcgucgccuggagcgccuccgccugccacgacggcaugggcuggcugaccaucgggaucagcggccccgacaacggggcgguggccgugcucaaguauaacggcaucaucaccgagacgaucaaauccuggcggaagaagauccugcgcacccaggagagcgagugcgccugcgucaacggcuccugcuucaccaucaugaccgacgggcccagugacggcccggccuccuacaagaucuucaagaucgagaaggggaaggugaccaagagcaucgagcuggacgcccccaacucccacuaugaggagugcagcugcuaccccgacacgggcaaggugaugugcgucugccgggacaauuggcacggguccaaccgccccugggugagcuucgaccagaaccucgacuaccaaaucggcuauaucugcuccggcguguucggggacaccccgcggcccaaggacggcaccgggagcugcggccccgucuccguggacggggcgaacggcgugaagggcuuuagcuaccgcuacggggacggcgucuggaucgggcggacgaagucccagagcucccgccacggcuucgagaugaucugggaucccaacggguggaccgagaccgacagccgguucagcgugcgccaggacguggucgccaucaccgacugguccggcuacaguggcuccuucgugcagcacccggagcugacggggcuggacugcaugcggcccugcuucugggucgagcucauccgcggccagcccaaggagaagaccaucuggaccagcggguccagcaucuccuuuugcggcgugaacagcgacaccguggacugguccuggcccgacggcgccgagcugccguucacgaucgacaaguga

SEQ ID NO: 19715 - RNA, 1395 nt, Artificial Sequence
  derived and/or modified CDS sequence (AUadapt) from InfluenzaA__ACV49570__NA
augaaccccaaccagaagaucaucaccaucggcucgaucugcaugguggucgggaucaucucccugauccuccagaucggcaacaucgugagcaucuggaucucccacucgauccagaccgggaaccagaaccacacggggaccugcgaccaguccaucaucaccuacaagaacagcaccugggugaaccagacguacgucaacgugguggccggcaaggacaccaccuccgucauccuggccggcaacagcucccugugcccgauccgcggcugggcgaucuacucgaaggacaacggggugcggaucggcuccaagggggacguguucgucauccgcgagcccuucaucagcugcucccaccucgagugccggaccuucuuccugacgcagggcgcccugcucaacgacaagcacucgaacgggaccgugaaggaccgcucccccuaccgggcccugaugagcugccccgugggcgaggccccgucccccuacaacagccgcuucgaguccgucgccuggucggcgagcgccugccacgacggcaugggguggcugaccaucggcaucuccgggcccgacgacggcgccguggccgugcucaaguacaacggcaucaucaccgagacgaucaagagcuggcggaaggagauccugcgcacccaggaguccgagugcgucugcgugaacgggucgugcuucaccaucaugaccgacggccccuccgggggcccggcgagcuacaagaucuucaagaucgagaaggggaaggugacgaaguccaucgagcuggacgcccccaacucgcacuacgaggagugcuccugcuaccccgacaccagcaaggucaugugcgugugccgggacaacuggcacggcuccaaccgccccugggugagcuucgaccagaaccucgacuaccagaugggcuacaucugcuccggggucuucggcgacaacccgcggcccaaggacgggaagggcucgugcgggcccguguacguggacggcgccaacggcgucaagggguucuccuacaaguacggcaacgggguguggaucggccgcaccaagagcaacuccucgcggcagggguucgagaugaucugggaccccaacggcuggaccgagacggacuccaacuucuucaccaagcaggacgucguggccgugaccgacuggagcggcuacagcggguccuucguccagcacccggagcugaccggccuggacugcaugcgccccugcuucuggguggagcucauccgggggcgccccaaggagaacacgaucuggaccucgggcuccagcaucuccuucugcggcgugaacagcgacaccgucgacugguccuggcccgacggggccgagcugccguucaccaucgacaaguga

SEQ ID NO: 19716 - RNA, 1410 nt, Artificial Sequence; identical to SEQ ID NO: 18806
  derived and/or modified CDS sequence (AUadapt) from InfluenzaA__ACV49581__NA

SEQ ID NO: 19717 - RNA, 1410 nt, Artificial Sequence; identical to SEQ ID NO: 18806
  derived and/or modified CDS sequence (AUadapt) from InfluenzaA__ACV49592__NA

SEQ ID NO: 19718 - RNA, 1410 nt, Artificial Sequence; identical to SEQ ID NO: 16336
  derived and/or modified CDS sequence (AUadapt) from InfluenzaA__ACV49603__NA

SEQ ID NO: 19719 - RNA, 1410 nt, Artificial Sequence
  derived and/or modified CDS sequence (AUadapt) from InfluenzaA__ACV49625__NA
augaaccccaaccagaagaccaucaccaucggcucggugucccugacgaucgagaccgucugcuuccucaugcagaucgccauccuggccaccaccgugacgcugcacuucaagcagcacgagugcgacucgccggcguccaaccaggugaugcccugcgagcccaucaucaucgagcgcaacaucaccgagaucgucuaccucaacaacaccaccaucgagaaggagaucugccccgaggugguggaguaccggaacuggucgaagccgcagugccagaucacgggguucgcccccuucuccaaggacaacagcauccgccuguccgccggcggggacaucugggucacccggggccccuacgugucgugcgaccccgggaagugcuaccaguucgcccugggccagggcaccacccucgacaacaagcacuccaacgggacgauccacgaccgcaucccgcaccggacccugcugaugaacgagcucggcgugcccuuccaccuggggaccaagcaggucugcguggccuggucguccagcuccugccacgacggcaaggcguggcugcacgugugcgucaccggggacgaccgcaacgccacggccucguucaucuacgacggccggcucguggacuccaucggcucguggucccagaacauccugcgcacccaggagagcgagugcgugugcaucaacgggaccugcaccgucgugaugacggacggcuccgccucggggcgggcggacacccgcauccuguucaucaaggagggcaagaucgugcacaucucgccccucuccggcagcgcccagcacaucgaggagugcuccugcuacccccgguacccggacguccgcugcaucugccgggacaacuggaaggggucgaaccgccccgugaucgacaucaacauggaggacuacuccaucgacucguccuacgugugcagcggccuggucggggacacgccccggaacgacgacuccucguccaacucgaacugccgcgaccccaacaacgagcggggcaacccgggggugaagggcugggccuucgacaacggcgacgacguguggauggggcgcaccaucuccaaggacagccgguccggcuacgagaccuucaaggucaucgggggcuggucgacccccaacuccaagucgcaggugaaccgccaggucaucguggacaacaacaacugguccggguacagcggcaucuucucgguggagggcaaguccugcaucaaccggugcuucuacgucgagcugauccgcgggcgcccccaggagacccgggugugguggaccucgaacuccaucguggucuucugcggcacgagcgggaccuacggcaccggguccuggcccgacggcgccaacaucaacuucaugccgaucuga

SEQ ID NO: 19720 - RNA, 1410 nt, Artificial Sequence; identical to SEQ ID NO: 18858
  derived and/or modified CDS sequence (AUadapt) from InfluenzaA__ACV49647__NA

SEQ ID NO: 19721 - RNA, 1413 nt, Artificial Sequence
  derived and/or modified CDS sequence (AUadapt) from InfluenzaA__ACV49669__NA
augaaccccaaccagaagaucaucaccaucggcucgaucugcauggccaucgggaucaucucccugauccuccagaucggcaacaucgugagcaucuggaucucccacucgauccagaccgggucccagaacuacacgggcaucugcaaccagcgcaucaucaccuacgagaacagcaccugggucaaccagaccuacgugaacaucaacaacacgaacguggucgccgggcaggacaccaccuccgugacccuggcgggcaacucgucccugugcccgaucagcggcugggccaucuacuccaaggacaacucgauccggaucggguccaagggcgacguguucgucauccgcgagcccuucaucagcugcucccaccucgagugccggacguucuuccugacccagggggcccugcucaacgacaagcacucgaacggcaccgugaaggaccgcucccccuaccgggcccugaugagcugccccaucggggaggccccgucccccuacaacucgcgcuucgagagcguggcgugguccgccagcgccugccacgacggcaugggcuggcugaccaucgggaucuccggccccgacgacggggccgucgcggugcucaaguacaacggcaucaucacggagaccaucaagucguggcggaagcgcauccugcggacccaggaguccgagugcgugugcgucaacggcagcugcuucaccaucaugacggacgggcccaacaacggcccggccuccuacaagaucuucaagaucgagaaggggaagaucaccaagucgaucgagcuggacgcccccaacucccacuacgaggagugcagcugcuaccccgacgccggcaccgugaugugcgugugccgcgacaacuggcacggguccaaccggcccugggucucguucaaccagaaccucgacuaccagaucggcuacaucugcuccggcguguucggggacaacccgcgccccaaggacggcaaggggagcugcggccccgugaccgucgacggggccgacggcgugaagggcuucuccuaccgguacgggaacggcguguggaucgggcgcaccaagucgaacuccagccggcgcggcuucgagaugaucugggaccccaacggguggacggacaccgacuccaaguuccuggucaagcaggacgugguggcgaugaccgacuggucgggcuacagcggcuccuucguccagcacccggagcugacggggcucgacugcaugcggcccugcuucuggguggagcugauccgcggccggccccgcgagaacaccaccaucuggaccucgggguccagcaucuccuucugcggcgucaacggcgacacggccaacuggagcuggcccgacggggccgagcugccguucaccaucgacaaguga

SEQ ID NO: 19722 - RNA, 1413 nt, Artificial Sequence
  derived and/or modified CDS sequence (AUadapt) from InfluenzaA__ACV49679__NA
augaaccccaaccagaagaucaucaccaucggcucgaucuccaucgccaucgggaucaucagccugaugcuccagaucggcuccaucaucagcaucugggccucccacucgauccgcaccgggucccagaacaacacgggcaucugcaaccagcggaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccgcaucggguccaagggcgacguguucgugauccgggagccguucaucagcugcucccaccucgagugccgcacguucuuccugacccagggggcccugcucaacgacaagcacucgaacggcaccgucaaggaccggucccccuaccgcgcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcggacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugucguucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccgccccugcuucugggucgagcuggugcgggggcucccgcgcgagaacaccaccaucuggaccuccggcucguccaucagcuucugcggggucaacuccgacacggccaacuggagcuggcccgacggcgccgagcugcccuucaccaucgacaaguga

SEQ ID NO: 19723 - RNA, 1410 nt, Artificial Sequence
  derived and/or modified CDS sequence (AUadapt) from InfluenzaA__ACV53442__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 19724 - RNA, 1410 nt, Artificial Sequence; identical to SEQ ID NO: 19507
  derived and/or modified CDS sequence (AUadapt) from InfluenzaA__ACV53452__NA

SEQ ID NO: 19725 - RNA, 1410 nt, Artificial Sequence; identical to SEQ ID NO: 16274
  derived and/or modified CDS sequence (AUadapt) from InfluenzaA__ACV53462__NA

SEQ ID NO: 19726 - RNA, 1410 nt, Artificial Sequence; identical to SEQ ID NO: 16318
  derived and/or modified CDS sequence (AUadapt) from InfluenzaA__ACV53472__NA

SEQ ID NO: 19727 - RNA, 1410 nt, Artificial Sequence
  derived and/or modified CDS sequence (AUadapt) from InfluenzaA__ACV53482__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccggcgagaucacgugcgucugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacgggaacggcguguggaucggccgcaccaaguccaucagcagccggaacggguucgagaugaucugggaccccaacggcuggaccgccaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaaguga

SEQ ID NO: 19728 - RNA, 1410 nt, Artificial Sequence
  derived and/or modified CDS sequence (AUadapt) from InfluenzaA__ACV53492__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaaggccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuuccugaucaagcaggacaucgugggcaucaacgaguggucgggguacuccggcagcuucgugcagcacccggagcugaccgggcucgacugcauccgccccugcuucugggucgagcugauccggggccgccccaaggagaacacgaucuggaccuccggcagcuccaucagcuucugcggggugaacuccgacaccgucggcuggagcuggcccgacggggcggagcugccguucaccaucgacaaguga

SEQ ID NO: 19729 - RNA, 1410 nt, Artificial Sequence
  derived and/or modified CDS sequence (AUadapt) from InfluenzaA__ACV53502__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaaggccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuuccugaucaagcaggacaucguggggaucaacgaguggucgggcuacuccgggagcuucgugcagcacccggagcugaccggccucgacugcauccgccccugcuucugggucgagcugauccggggccgccccaaggagaacacgaucuggaccuccgggagcuccaucagcuucugcggcgugaacuccgacaccgucggguggagcuggcccgacggcgcggagcugccguucaccaucgacaaguga

SEQ ID NO: 19730 - RNA, 1410 nt, Artificial Sequence
  derived and/or modified CDS sequence (AUadapt) from InfluenzaA__ACV53891__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaagauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugcgaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19731 - RNA, 1410 nt, Artificial Sequence
  derived and/or modified CDS sequence (AUadapt) from InfluenzaA__ACV53901__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagccgcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 19732 - RNA, 1410 nt, Artificial Sequence; identical to SEQ ID NO: 16318
  derived and/or modified CDS sequence (AUadapt) from InfluenzaA__ACV53911__NA

SEQ ID NO: 19733 - RNA, 1410 nt, Artificial Sequence; identical to SEQ ID NO: 16274
  derived and/or modified CDS sequence (AUadapt) from InfluenzaA__ACV67088__NA

SEQ ID NO: 19734 - RNA, 1410 nt, Artificial Sequence; identical to SEQ ID NO: 16318
  derived and/or modified CDS sequence (AUadapt) from InfluenzaA__ACV67168__NA

SEQ ID NO: 19735 - RNA, 1410 nt, Artificial Sequence; identical to SEQ ID NO: 16274
  derived and/or modified CDS sequence (AUadapt) from InfluenzaA__ACV67169__NA

SEQ ID NO: 19736 - RNA, 1410 nt, Artificial Sequence; identical to SEQ ID NO: 16318
  derived and/or modified CDS sequence (AUadapt) from InfluenzaA__ACV67171__NA

SEQ ID NO: 19737 - RNA, 1410 nt, Artificial Sequence; identical to SEQ ID NO: 16318
  derived and/or modified CDS sequence (AUadapt) from InfluenzaA__ACV67172__NA

SEQ ID NO: 19738 - RNA, 1410 nt, Artificial Sequence; identical to SEQ ID NO: 19170
  derived and/or modified CDS sequence (AUadapt) from InfluenzaA__ACV67173__NA

SEQ ID NO: 19739 - RNA, 1410 nt, Artificial Sequence; identical to SEQ ID NO: 16274
  derived and/or modified CDS sequence (AUadapt) from InfluenzaA__ACV67174__NA

SEQ ID NO: 19740 - RNA, 1410 nt, Artificial Sequence
  derived and/or modified CDS sequence (AUadapt) from InfluenzaA__ACV67175__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggguccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 19741 - RNA, 1410 nt, Artificial Sequence; identical to SEQ ID NO: 16318
  derived and/or modified CDS sequence (AUadapt) from InfluenzaA__ACV67176__NA

SEQ ID NO: 19742 - RNA, 1410 nt, Artificial Sequence; identical to SEQ ID NO: 16274
  derived and/or modified CDS sequence (AUadapt) from InfluenzaA__ACV67177__NA

SEQ ID NO: 19743 - RNA, 1410 nt, Artificial Sequence; identical to SEQ ID NO: 16318
  derived and/or modified CDS sequence (AUadapt) from InfluenzaA__ACV67178__NA

SEQ ID NO: 19744 - RNA, 1410 nt, Artificial Sequence; identical to SEQ ID NO: 16318
  derived and/or modified CDS sequence (AUadapt) from InfluenzaA__ACV67179__NA

SEQ ID NO: 19745 - RNA, 1410 nt, Artificial Sequence
  derived and/or modified CDS sequence (AUadapt) from InfluenzaA__ACV67180__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagccggucgugagcgugaagcuggccgggaacuccucgcucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcucaccaucggcaucucgggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 19746 - RNA, 1410 nt, Artificial Sequence
  derived and/or modified CDS sequence (AUadapt) from InfluenzaA__ACV67181__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucaucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucaucaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19747 - RNA, 1410 nt, Artificial Sequence; identical to SEQ ID NO: 19564
  derived and/or modified CDS sequence (AUadapt) from InfluenzaA__ACV67182__NA

SEQ ID NO: 19748 - RNA, 1410 nt, Artificial Sequence
  derived and/or modified CDS sequence (AUadapt) from InfluenzaA__ACV67183__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcgugcgcaucggcuccaagggggacguguucgucauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccucguacaagaucuuccgcaucgagaaggggaagaucgugaaguccguggagaugaacgcccccaacuaccacuacgaggagugcagcugcuaccccgacuccaacgagaucacgugcgucugccgggacaacuggcacggcagcaaccgccccuggguguccuucaaccagaaccucgaguaccagaucggguacaucugcagcggcaucuucggggacaacccgcggcccaacgacaagaccggcuccugcggccccgugucguccaacggggccaacggcgucaagggguucagcuucaaguacggcaacgggguguggaucggccgcaccaaguccaucaacagccggaacggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 19749 - RNA, 1410 nt, Artificial Sequence; identical to SEQ ID NO: 16318
  derived and/or modified CDS sequence (AUadapt) from InfluenzaA__ACV67184__NA

SEQ ID NO: 19750 - RNA, 1410 nt, Artificial Sequence; identical to SEQ ID NO: 16274
  derived and/or modified CDS sequence (AUadapt) from InfluenzaA__ACV67186__NA

SEQ ID NO: 19751 - RNA, 1410 nt, Artificial Sequence; identical to SEQ ID NO: 16318
  derived and/or modified CDS sequence (AUadapt) from InfluenzaA__ACV67187__NA

SEQ ID NO: 19752 - RNA, 1410 nt, Artificial Sequence; identical to SEQ ID NO: 16318
  derived and/or modified CDS sequence (AUadapt) from InfluenzaA__ACV67188__NA

SEQ ID NO: 19753 - RNA, 1410 nt, Artificial Sequence; identical to SEQ ID NO: 19170
  derived and/or modified CDS sequence (AUadapt) from InfluenzaA__ACV67189__NA

SEQ ID NO: 19754 - RNA, 1410 nt, Artificial Sequence; identical to SEQ ID NO: 19170
  derived and/or modified CDS sequence (AUadapt) from InfluenzaA__ACV67190__NA

SEQ ID NO: 19755 - RNA, 1410 nt, Artificial Sequence; identical to SEQ ID NO: 16274
  derived and/or modified CDS sequence (AUadapt) from InfluenzaA__ACV67191__NA

SEQ ID NO: 19756 - RNA, 1410 nt, Artificial Sequence; identical to SEQ ID NO: 19170
  derived and/or modified CDS sequence (AUadapt) from InfluenzaA__ACV67192__NA

SEQ ID NO: 19757 - RNA, 1410 nt, Artificial Sequence; identical to SEQ ID NO: 19170
  derived and/or modified CDS sequence (AUadapt) from InfluenzaA__ACV67193__NA

SEQ ID NO: 19758 - RNA, 1410 nt, Artificial Sequence; identical to SEQ ID NO: 16318
  derived and/or modified CDS sequence (AUadapt) from InfluenzaA__ACV67194__NA

SEQ ID NO: 19759 - RNA, 1410 nt, Artificial Sequence; identical to SEQ ID NO: 16318
  derived and/or modified CDS sequence (AUadapt) from InfluenzaA__ACV67195__NA

SEQ ID NO: 19760 - RNA, 1410 nt, Artificial Sequence; identical to SEQ ID NO: 16318
  derived and/or modified CDS sequence (AUadapt) from InfluenzaA__ACV67196__NA

SEQ ID NO: 19761 - RNA, 1410 nt, Artificial Sequence; identical to SEQ ID NO: 16274
  derived and/or modified CDS sequence (AUadapt) from InfluenzaA__ACV67197__NA

SEQ ID NO: 19762 - RNA, 1410 nt, Artificial Sequence; identical to SEQ ID NO: 16274
  derived and/or modified CDS sequence (AUadapt) from InfluenzaA__ACV67199__NA

SEQ ID NO: 19763 - RNA, 1410 nt, Artificial Sequence; identical to SEQ ID NO: 16274
  derived and/or modified CDS sequence (AUadapt) from InfluenzaA__ACV67200__NA

SEQ ID NO: 19764 - RNA, 1410 nt, Artificial Sequence; identical to SEQ ID NO: 16274
  derived and/or modified CDS sequence (AUadapt) from InfluenzaA__ACV67201__NA

SEQ ID NO: 19765 - RNA, 1410 nt, Artificial Sequence; identical to SEQ ID NO: 16274
  derived and/or modified CDS sequence (AUadapt) from InfluenzaA__ACV67202__NA

SEQ ID NO: 19766 - RNA, 1410 nt, Artificial Sequence; identical to SEQ ID NO: 16318
  derived and/or modified CDS sequence (AUadapt) from InfluenzaA__ACV67203__NA

SEQ ID NO: 19767 - RNA, 1410 nt, Artificial Sequence; identical to SEQ ID NO: 16318
  derived and/or modified CDS sequence (AUadapt) from InfluenzaA__ACV67204__NA

SEQ ID NO: 19768 - RNA, 1410 nt, Artificial Sequence; identical to SEQ ID NO: 16318
  derived and/or modified CDS sequence (AUadapt) from InfluenzaA__ACV67205__NA

SEQ ID NO: 19769 - RNA, 1410 nt, Artificial Sequence
  derived and/or modified CDS sequence (AUadapt) from InfluenzaA__ACV67206__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacagcucccucugcccggugucgggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19770 - RNA, 1410 nt, Artificial Sequence; identical to SEQ ID NO: 16274
  derived and/or modified CDS sequence (AUadapt) from InfluenzaA__ACV67207__NA

SEQ ID NO: 19771 - RNA, 1410 nt, Artificial Sequence; identical to SEQ ID NO: 16318
  derived and/or modified CDS sequence (AUadapt) from InfluenzaA__ACV67208__NA

SEQ ID NO: 19772 - RNA, 1410 nt, Artificial Sequence; identical to SEQ ID NO: 16274
  derived and/or modified CDS sequence (AUadapt) from InfluenzaA__ACV67210__NA

SEQ ID NO: 19773 - RNA, 1410 nt, Artificial Sequence; identical to SEQ ID NO: 16318
  derived and/or modified CDS sequence (AUadapt) from InfluenzaA__ACV67211__NA

SEQ ID NO: 19774 - RNA, 1410 nt, Artificial Sequence; identical to SEQ ID NO: 16318
  derived and/or modified CDS sequence (AUadapt) from InfluenzaA__ACV70076__NA

SEQ ID NO: 19775 - RNA, 1410 nt, Artificial Sequence
  derived and/or modified CDS sequence (AUadapt) from InfluenzaA__ACV70086__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19776 - RNA, 1410 nt, Artificial Sequence
  derived and/or modified CDS sequence (AUadapt) from InfluenzaA__ACV70096__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucaccgccggccagagcgucguguccgugaagcuggcggggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 19777 - RNA, 1410 nt, Artificial Sequence; identical to SEQ ID NO: 16318
  derived and/or modified CDS sequence (AUadapt) from InfluenzaA__ACV70106__NA

SEQ ID NO: 19778 - RNA, 1410 nt, Artificial Sequence; identical to SEQ ID NO: 16318
  derived and/or modified CDS sequence (AUadapt) from InfluenzaA__ACV70116__NA

SEQ ID NO: 19779 - RNA, 1410 nt, Artificial Sequence; identical to SEQ ID NO: 16318
  derived and/or modified CDS sequence (AUadapt) from InfluenzaA__ACV70126__NA

SEQ ID NO: 19780 - RNA, 1410 nt, Artificial Sequence; identical to SEQ ID NO: 16318
  derived and/or modified CDS sequence (AUadapt) from InfluenzaA__ACV70157__NA

SEQ ID NO: 19781 - RNA, 1410 nt, Artificial Sequence; identical to SEQ ID NO: 16274
  derived and/or modified CDS sequence (AUadapt) from InfluenzaA__ACV70167__NA

SEQ ID NO: 19782 - RNA, 1410 nt, Artificial Sequence; identical to SEQ ID NO: 16318
  derived and/or modified CDS sequence (AUadapt) from InfluenzaA__ACV70177__NA

SEQ ID NO: 19783 - RNA, 1410 nt, Artificial Sequence; identical to SEQ ID NO: 16318
  derived and/or modified CDS sequence (AUadapt) from InfluenzaA__ACV70187__NA

SEQ ID NO: 19784 - RNA, 1410 nt, Artificial Sequence; identical to SEQ ID NO: 16318
  derived and/or modified CDS sequence (AUadapt) from InfluenzaA__ACV70197__NA

SEQ ID NO: 19785 - RNA, 1410 nt, Artificial Sequence; identical to SEQ ID NO: 16318
  derived and/or modified CDS sequence (AUadapt) from InfluenzaA__ACV70207__NA

SEQ ID NO: 19786 - RNA, 1410 nt, Artificial Sequence
  derived and/or modified CDS sequence (AUadapt) from InfluenzaA__ACV70217__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucccaccuggagugccgcaccuucuuccugacccagggcgcccuccugaacgacaagcacagcaacgggaccaucaaggaccggucccccuaccgcacgcugaugucgugccccaucggcgaggugccgucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggccccuccaacggccaggccagcuacaagaucuuccgcaucgagaaggggaagaucgugaaguccguggagaugaacgccccgaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccccggccgaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcaccccgagcugacgggccuggacugcauccgcccgugcuucuggguggagcucauccggggccgccccaaggagaacaccaucuggaccagcggguccagcaucuccuucugcggcgucaacagcgacaccguggggugguccuggcccgacggcgccgagcugcccuucacgaucgacaaguga

SEQ ID NO: 19787 - RNA, 1410 nt, Artificial Sequence; identical to SEQ ID NO: 16318
  derived and/or modified CDS sequence (AUadapt) from InfluenzaA__ACV70227__NA

SEQ ID NO: 19788 - RNA, 1410 nt, Artificial Sequence; identical to SEQ ID NO: 16318
  derived and/or modified CDS sequence (AUadapt) from InfluenzaA__ACV70237__NA

SEQ ID NO: 19789 - RNA, 1410 nt, Artificial Sequence; identical to SEQ ID NO: 16318
  derived and/or modified CDS sequence (AUadapt) from InfluenzaA__ACV70247__NA

SEQ ID NO: 19790 - RNA, 1410 nt, Artificial Sequence; identical to SEQ ID NO: 16318
  derived and/or modified CDS sequence (AUadapt) from InfluenzaA__ACV70257__NA

SEQ ID NO: 19791 - RNA, 1410 nt, Artificial Sequence; identical to SEQ ID NO: 16318
  derived and/or modified CDS sequence (AUadapt) from InfluenzaA__ACV70267__NA

SEQ ID NO: 19792 - RNA, 1410 nt, Artificial Sequence; identical to SEQ ID NO: 16318
  derived and/or modified CDS sequence (AUadapt) from InfluenzaA__ACV70277__NA

SEQ ID NO: 19793 - RNA, 1410 nt, Artificial Sequence; identical to SEQ ID NO: 16318
  derived and/or modified CDS sequence (AUadapt) from InfluenzaA__ACV70287__NA

SEQ ID NO: 19794 - RNA, 1410 nt, Artificial Sequence; identical to SEQ ID NO: 16318
  derived and/or modified CDS sequence (AUadapt) from InfluenzaA__ACV70297__NA

SEQ ID NO: 19795 - RNA, 1410 nt, Artificial Sequence; identical to SEQ ID NO: 16318
  derived and/or modified CDS sequence (AUadapt) from InfluenzaA__ACV70307__NA

SEQ ID NO: 19796 - RNA, 1410 nt, Artificial Sequence; identical to SEQ ID NO: 16274
  derived and/or modified CDS sequence (AUadapt) from InfluenzaA__ACV70317__NA

SEQ ID NO: 19797 - RNA, 1410 nt, Artificial Sequence; identical to SEQ ID NO: 16318
  derived and/or modified CDS sequence (AUadapt) from InfluenzaA__ACV70327__NA

SEQ ID NO: 19798 - RNA, 1410 nt, Artificial Sequence; identical to SEQ ID NO: 16318
  derived and/or modified CDS sequence (AUadapt) from InfluenzaA__ACV70337__NA

SEQ ID NO: 19799 - RNA, 1410 nt, Artificial Sequence; identical to SEQ ID NO: 16318
  derived and/or modified CDS sequence (AUadapt) from InfluenzaA__ACV70347__NA

SEQ ID NO: 19800 - RNA, 1410 nt, Artificial Sequence; identical to SEQ ID NO: 16318
  derived and/or modified CDS sequence (AUadapt) from InfluenzaA__ACV70357__NA

SEQ ID NO: 19801 - RNA, 1410 nt, Artificial Sequence; identical to SEQ ID NO: 16318
  derived and/or modified CDS sequence (AUadapt) from InfluenzaA__ACV70367__NA

SEQ ID NO: 19802 - RNA, 1410 nt, Artificial Sequence; identical to SEQ ID NO: 16318
  derived and/or modified CDS sequence (AUadapt) from InfluenzaA__ACV70377__NA

SEQ ID NO: 19803 - RNA, 1410 nt, Artificial Sequence; identical to SEQ ID NO: 16318
  derived and/or modified CDS sequence (AUadapt) from InfluenzaA__ACV70387__NA

SEQ ID NO: 19804 - RNA, 1410 nt, Artificial Sequence; identical to SEQ ID NO: 16318
  derived and/or modified CDS sequence (AUadapt) from InfluenzaA__ACV70397__NA

SEQ ID NO: 19805 - RNA, 1410 nt, Artificial Sequence; identical to SEQ ID NO: 16318
  derived and/or modified CDS sequence (AUadapt) from InfluenzaA__ACV70407__NA

SEQ ID NO: 19806 - RNA, 1410 nt, Artificial Sequence; identical to SEQ ID NO: 16274
  derived and/or modified CDS sequence (AUadapt) from InfluenzaA__ACV70417__NA

SEQ ID NO: 19807 - RNA, 1410 nt, Artificial Sequence; identical to SEQ ID NO: 16318
  derived and/or modified CDS sequence (AUadapt) from InfluenzaA__ACV70427__NA

SEQ ID NO: 19808 - RNA, 1410 nt, Artificial Sequence; identical to SEQ ID NO: 16318
  derived and/or modified CDS sequence (AUadapt) from InfluenzaA__ACV70437__NA

SEQ ID NO: 19809 - RNA, 1410 nt, Artificial Sequence; identical to SEQ ID NO: 16318
  derived and/or modified CDS sequence (AUadapt) from InfluenzaA__ACV70447__NA

SEQ ID NO: 19810 - RNA, 1410 nt, Artificial Sequence; identical to SEQ ID NO: 16318
  derived and/or modified CDS sequence (AUadapt) from InfluenzaA__ACV70457__NA

SEQ ID NO: 19811 - RNA, 1410 nt, Artificial Sequence; identical to SEQ ID NO: 16318
  derived and/or modified CDS sequence (AUadapt) from InfluenzaA__ACV70467__NA

SEQ ID NO: 19812 - RNA, 1410 nt, Artificial Sequence; identical to SEQ ID NO: 16318
  derived and/or modified CDS sequence (AUadapt) from InfluenzaA__ACV70477__NA

SEQ ID NO: 19813 - RNA, 1410 nt, Artificial Sequence; identical to SEQ ID NO: 16318
  derived and/or modified CDS sequence (AUadapt) from InfluenzaA__ACV70487__NA

SEQ ID NO: 19814 - RNA, 1410 nt, Artificial Sequence; identical to SEQ ID NO: 16318
  derived and/or modified CDS sequence (AUadapt) from InfluenzaA__ACV70497__NA

SEQ ID NO: 19815 - RNA, 1410 nt, Artificial Sequence; identical to SEQ ID NO: 16318
  derived and/or modified CDS sequence (AUadapt) from InfluenzaA__ACV70507__NA

SEQ ID NO: 19816 - RNA, 1410 nt, Artificial Sequence; identical to SEQ ID NO: 16318
  derived and/or modified CDS sequence (AUadapt) from InfluenzaA__ACV70517__NA

SEQ ID NO: 19817 - RNA, 1410 nt, Artificial Sequence; identical to SEQ ID NO: 16318
  derived and/or modified CDS sequence (AUadapt) from InfluenzaA__ACV70527__NA

SEQ ID NO: 19818 - RNA, 1410 nt, Artificial Sequence; identical to SEQ ID NO: 16318
  derived and/or modified CDS sequence (AUadapt) from InfluenzaA__ACV70547__NA

SEQ ID NO: 19819 - RNA, 1410 nt, Artificial Sequence; identical to SEQ ID NO: 16318
  derived and/or modified CDS sequence (AUadapt) from InfluenzaA__ACV70557__NA

SEQ ID NO: 19820 - RNA, 1410 nt, Artificial Sequence; identical to SEQ ID NO: 16318
  derived and/or modified CDS sequence (AUadapt) from InfluenzaA__ACV70567__NA

SEQ ID NO: 19821 - RNA, 1410 nt, Artificial Sequence; identical to SEQ ID NO: 16318
  derived and/or modified CDS sequence (AUadapt) from InfluenzaA__ACV70577__NA

SEQ ID NO: 19822 - RNA, 1410 nt, Artificial Sequence; identical to SEQ ID NO: 16318
  derived and/or modified CDS sequence (AUadapt) from InfluenzaA__ACV70587__NA

SEQ ID NO: 19823 - RNA, 1410 nt, Artificial Sequence; identical to SEQ ID NO: 16274
  derived and/or modified CDS sequence (AUadapt) from InfluenzaA__ACV70597__NA

SEQ ID NO: 19824 - RNA, 1410 nt, Artificial Sequence; identical to SEQ ID NO: 16318
  derived and/or modified CDS sequence (AUadapt) from InfluenzaA__ACV70607__NA

SEQ ID NO: 19825 - RNA, 1410 nt, Artificial Sequence; identical to SEQ ID NO: 19723
  derived and/or modified CDS sequence (AUadapt) from InfluenzaA__ACV70617__NA

SEQ ID NO: 19826 - RNA, 1410 nt, Artificial Sequence; identical to SEQ ID NO: 16318
  derived and/or modified CDS sequence (AUadapt) from InfluenzaA__ACV70647__NA

SEQ ID NO: 19827 - RNA, 1410 nt, Artificial Sequence; identical to SEQ ID NO: 16318
  derived and/or modified CDS sequence (AUadapt) from InfluenzaA__ACV70657__NA

SEQ ID NO: 19828 - RNA, 1410 nt, Artificial Sequence; identical to SEQ ID NO: 16318
  derived and/or modified CDS sequence (AUadapt) from InfluenzaA__ACV70667__NA

SEQ ID NO: 19829 - RNA, 1410 nt, Artificial Sequence; identical to SEQ ID NO: 16318
  derived and/or modified CDS sequence (AUadapt) from InfluenzaA__ACV70677__NA

SEQ ID NO: 19830 - RNA, 1410 nt, Artificial Sequence; identical to SEQ ID NO: 16318
  derived and/or modified CDS sequence (AUadapt) from InfluenzaA__ACV70687__NA

SEQ ID NO: 19831 - RNA, 1410 nt, Artificial Sequence; identical to SEQ ID NO: 16318
  derived and/or modified CDS sequence (AUadapt) from InfluenzaA__ACV70697__NA

SEQ ID NO: 19832 - RNA, 1410 nt, Artificial Sequence; identical to SEQ ID NO: 16318
  derived and/or modified CDS sequence (AUadapt) from InfluenzaA__ACV70707__NA

SEQ ID NO: 19833 - RNA, 1410 nt, Artificial Sequence; identical to SEQ ID NO: 16318
  derived and/or modified CDS sequence (AUadapt) from InfluenzaA__ACV70717__NA

SEQ ID NO: 19834 - RNA, 1410 nt, Artificial Sequence; identical to SEQ ID NO: 16318
  derived and/or modified CDS sequence (AUadapt) from InfluenzaA__ACV70727__NA

SEQ ID NO: 19835 - RNA, 1410 nt, Artificial Sequence; identical to SEQ ID NO: 16318
  derived and/or modified CDS sequence (AUadapt) from InfluenzaA__ACV70737__NA

SEQ ID NO: 19836 - RNA, 1410 nt, Artificial Sequence; identical to SEQ ID NO: 16318
  derived and/or modified CDS sequence (AUadapt) from InfluenzaA__ACV70757__NA

SEQ ID NO: 19837 - RNA, 1410 nt, Artificial Sequence; identical to SEQ ID NO: 16318
  derived and/or modified CDS sequence (AUadapt) from InfluenzaA__ACV70767__NA

SEQ ID NO: 19838 - RNA, 1410 nt, Artificial Sequence; identical to SEQ ID NO: 16318
  derived and/or modified CDS sequence (AUadapt) from InfluenzaA__ACV70777__NA

SEQ ID NO: 19839 - RNA, 1410 nt, Artificial Sequence; identical to SEQ ID NO: 16318
  derived and/or modified CDS sequence (AUadapt) from InfluenzaA__ACV70787__NA

SEQ ID NO: 19840 - RNA, 1410 nt, Artificial Sequence; identical to SEQ ID NO: 16318
  derived and/or modified CDS sequence (AUadapt) from InfluenzaA__ACV70797__NA

SEQ ID NO: 19841 - RNA, 1410 nt, Artificial Sequence; identical to SEQ ID NO: 16318
  derived and/or modified CDS sequence (AUadapt) from InfluenzaA__ACV70807__NA

SEQ ID NO: 19842 - RNA, 1410 nt, Artificial Sequence; identical to SEQ ID NO: 16318
  derived and/or modified CDS sequence (AUadapt) from InfluenzaA__ACV70817__NA

SEQ ID NO: 19843 - RNA, 1410 nt, Artificial Sequence; identical to SEQ ID NO: 16274
  derived and/or modified CDS sequence (AUadapt) from InfluenzaA__ACV70827__NA

SEQ ID NO: 19844 - RNA, 1410 nt, Artificial Sequence; identical to SEQ ID NO: 16318
  derived and/or modified CDS sequence (AUadapt) from InfluenzaA__ACV70837__NA

SEQ ID NO: 19845 - RNA, 1410 nt, Artificial Sequence
  derived and/or modified CDS sequence (AUadapt) from InfluenzaA__ACV70847__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaugagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19846 - RNA, 1410 nt, Artificial Sequence; identical to SEQ ID NO: 16318
  derived and/or modified CDS sequence (AUadapt) from InfluenzaA__ACV70867__NA

SEQ ID NO: 19847 - RNA, 1410 nt, Artificial Sequence; identical to SEQ ID NO: 16318
  derived and/or modified CDS sequence (AUadapt) from InfluenzaA__ACV70877__NA

SEQ ID NO: 19848 - RNA, 1410 nt, Artificial Sequence
  derived and/or modified CDS sequence (AUadapt) from InfluenzaA__ACV70887__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcuggccgggaacucgucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19849 - RNA, 1410 nt, Artificial Sequence; identical to SEQ ID NO: 16318
  derived and/or modified CDS sequence (AUadapt) from InfluenzaA__ACV70897__NA

SEQ ID NO: 19850 - RNA, 1410 nt, Artificial Sequence; identical to SEQ ID NO: 16318
  derived and/or modified CDS sequence (AUadapt) from InfluenzaA__ACV70907__NA

SEQ ID NO: 19851 - RNA, 1410 nt, Artificial Sequence; identical to SEQ ID NO: 16318
  derived and/or modified CDS sequence (AUadapt) from InfluenzaA__ACV70917__NA

SEQ ID NO: 19852 - RNA, 1410 nt, Artificial Sequence; identical to SEQ ID NO: 16274
  derived and/or modified CDS sequence (AUadapt) from InfluenzaA__ACV70927__NA

SEQ ID NO: 19853 - RNA, 1410 nt, Artificial Sequence; identical to SEQ ID NO: 16318
  derived and/or modified CDS sequence (AUadapt) from InfluenzaA__ACV70937__NA

SEQ ID NO: 19854 - RNA, 1410 nt, Artificial Sequence; identical to SEQ ID NO: 16318
  derived and/or modified CDS sequence (AUadapt) from InfluenzaA__ACV70947__NA

SEQ ID NO: 19855 - RNA, 1410 nt, Artificial Sequence; identical to SEQ ID NO: 16318
  derived and/or modified CDS sequence (AUadapt) from InfluenzaA__ACV70957__NA

SEQ ID NO: 19856 - RNA, 1410 nt, Artificial Sequence; identical to SEQ ID NO: 16318
  derived and/or modified CDS sequence (AUadapt) from InfluenzaA__ACV70967__NA

SEQ ID NO: 19857 - RNA, 1410 nt, Artificial Sequence; identical to SEQ ID NO: 16318
  derived and/or modified CDS sequence (AUadapt) from InfluenzaA__ACV70977__NA

SEQ ID NO: 19858 - RNA, 1410 nt, Artificial Sequence; identical to SEQ ID NO: 16318
  derived and/or modified CDS sequence (AUadapt) from InfluenzaA__ACV70987__NA

SEQ ID NO: 19859 - RNA, 1410 nt, Artificial Sequence; identical to SEQ ID NO: 16318
  derived and/or modified CDS sequence (AUadapt) from InfluenzaA__ACV71007__NA

SEQ ID NO: 19860 - RNA, 1410 nt, Artificial Sequence; identical to SEQ ID NO: 19001
  derived and/or modified CDS sequence (AUadapt) from InfluenzaA__ACV82218__NA

SEQ ID NO: 19861 - RNA, 1410 nt, Artificial Sequence; identical to SEQ ID NO: 19001
  derived and/or modified CDS sequence (AUadapt) from InfluenzaA__ACV82219__NA

SEQ ID NO: 19862 - RNA, 1410 nt, Artificial Sequence
  derived and/or modified CDS sequence (AUadapt) from InfluenzaA__ACV82220__NA
augaaccccaaccagaagaucaucaccaucggcucggugucccugaccaucagcacgaucugcuucuucaugcagcucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggucgaagccgcagugcgacaucaccggguucgcgcccuucuccaaggacaacagcauccgccucuccgccggcggggacaucugggucacccgggagcccuacgugucgugcgaccccgacaagugcuaccaguucgcccugggccaggggaccacgcugaacaacgugcacuccaacaacaccguccgcgaccggaccccguaccgcacccuccugaugaacgagcugggcgugcccuuccaccucggcacgaagcaggucugcaucgccuggagcuccuacucgugccacgacgggaaggccuggcugcacgugugcaucaccggcgacgacaagaacgcgaccgccuccuucaucuacaacgggcggcugguggacagcguggucuccuggucgaaggagauccuccgcacccaggaguccgagugcgugugcaucaacggcacgugcaccguggucaugaccgacgggagcgccuccggcaaggccgacaccaagauccuguucaucgaggagggcaagaucgugcacacgucgacccugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccucgugggcgacacgccccggaagaacgacucguccagcuccucgcacugccuggaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcuccagaucaaccgccaggugaucguggaccggggcaaccgcuccggguacagcggcaucuucuccgucgagggcaagucgugcaucaaccggugcuucuacguggagcugauccgcgggcggaaggagaagaccgaggugcuguggaccagcaacuccaucgucguguucugcggcaccagcgggacguacggcaccggguccuggccggacggcgccgacaucaaccucaugcccaucuga

SEQ ID NO: 19863 - RNA, 1413 nt, Artificial Sequence
  derived and/or modified CDS sequence (AUadapt) from InfluenzaA__ACV82221__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 19864 - RNA, 1410 nt, Artificial Sequence; identical to SEQ ID NO: 16318
  derived and/or modified CDS sequence (AUadapt) from InfluenzaA__ACV88402__NA

SEQ ID NO: 19865 - RNA, 1410 nt, Artificial Sequence; identical to SEQ ID NO: 16318
  derived and/or modified CDS sequence (AUadapt) from InfluenzaA__ACV88412__NA

SEQ ID NO: 19866 - RNA, 1410 nt, Artificial Sequence; identical to SEQ ID NO: 16274
  derived and/or modified CDS sequence (AUadapt) from InfluenzaA__ACV88422__NA

SEQ ID NO: 19867 - RNA, 1365 nt, Artificial Sequence
  derived and/or modified CDS sequence (AUadapt) from InfluenzaA__ACV89505__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacaguaccugggugaaggacaccacguccgugauccucaccgggaacagcucccugugcccgauccgcggcugggccaucuacagcaaggacaacuccauccggaucggcagcaagggggacgucuucgugauccgcgagcccuucaucuccugcucgcaucuggagugccggaccuucuuccucacccagggcgcccugcugaacgacaagcacuccagcgggacggugaaggaccgcucccccuaccgggcgcucaugagcugccccgucggcgaggccccgucccccuacaacagccgcuuugagagcguggccugguccgccagcgccugccacgacgggaugggcuggcugaccaucggcaucuccgggcccgacaacggcgcgguggccguccugaaguacaacgggaucaucaccgagaccaucaagagcuggcggaagaagauccuccgcacgcaggaguccgagugcgccugcgugaacggcucguguuucaccaucaugaccgacggccccuccgacgggcuggccagcuacaagaucuucaagaucgagaagggcaaggugaccaaguccaucgagcugaacgcgccgaacagccacuacgaggagugcuccugcuaccccgauacggggaaggucaugugcgugugccgggacaacuggcacggcagcaaccgccccuggguguccuucgaccagaaccucgacuaccagaucggguacaucugcaguggcgucuucggcgacaacccccggccggaggacgggaccggcuccugcgggcccguguacguggacggcgccaacggggucaagggcuucagcuaccgcuacggcaacgggguguggaucggccggaccaagucccacaguucccgccacggguucgagaugaucugggaccccaacggcuggaccgagacggacucgaaguucagcgugcggcaggacgucguggccaugaccgacugguccggguacagcggcuccuucgugcagcaccccgagcugaccggccuggauugcaugcgcccgugcuucugggucgagcucauccgggggcgccccaaggagggcaccaucuggacgagcgccuccagcaucuccuucugcggggugaacagcgacaccgucgacugguccuggcccgacggcgccgagcugcccuucagcaucgacaaguga

SEQ ID NO: 19868 - RNA, 1410 nt, Artificial Sequence; identical to SEQ ID NO: 16318
  derived and/or modified CDS sequence (AUadapt) from InfluenzaA__ACV91673__NA

SEQ ID NO: 19869 - RNA, 1410 nt, Artificial Sequence; identical to SEQ ID NO: 16318
  derived and/or modified CDS sequence (AUadapt) from InfluenzaA__ACV91681__NA

SEQ ID NO: 19870 - RNA, 1410 nt, Artificial Sequence
  derived and/or modified CDS sequence (AUadapt) from InfluenzaA__ACX31593__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugcugcucugcgagcccgccaucaucgagcgcaacaucacggagaucguguaccugaccaacaccaccaucgagaaggagaucugccccaagcuggcggaguaccggaacuggucgaagccgcagugcgacaucacgggguucgcccccuucuccaaggacaacagcauccgccucuccgccggcggggacaucugggucacccgggagcccuacgugucgugcgaccccgacaagugcuaccaguucgcccugggccaggggaccacccugaacaacgugcacuccaacaacacgguccgcgaccggaccccguaccgcacccuccugaugaacgagcugggcgugcccuuccaccucggcaccaagcaggucugcaucgccuggagcuccucguccugccacgacgggaaggcguggcugcacgugugcaucacgggcgacgacaagaacgccaccgccagcuucaucuacaacgggcggcugguggacuccguggucucgugguccaaggagauccuccgcacccaggagagcgagugcgugugcaucaacgggaccugcacgguggucaugaccgacggguccgccucgggcaaggcggacaccaagauccuguucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcuccagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcuguggaccuccaacagcaucgucguguucugcggcaccuccgggaccuacggcacggggagcuggccggacggcgccgacaucaaccucaugcccaucuga

SEQ ID NO: 19871 - RNA, 1410 nt, Artificial Sequence; identical to SEQ ID NO: 16318
  derived and/or modified CDS sequence (AUadapt) from InfluenzaA__ACX31901__NA

SEQ ID NO: 19872 - RNA, 1410 nt, Artificial Sequence; identical to SEQ ID NO: 16318
  derived and/or modified CDS sequence (AUadapt) from InfluenzaA__ACX31902__NA

SEQ ID NO: 19873 - RNA, 1410 nt, Artificial Sequence; identical to SEQ ID NO: 16318
  derived and/or modified CDS sequence (AUadapt) from InfluenzaA__ACX31905__NA

SEQ ID NO: 19874 - RNA, 1410 nt, Artificial Sequence; identical to SEQ ID NO: 16318
  derived and/or modified CDS sequence (AUadapt) from InfluenzaA__ACX31906__NA

SEQ ID NO: 19875 - RNA, 1410 nt, Artificial Sequence; identical to SEQ ID NO: 16318
  derived and/or modified CDS sequence (AUadapt) from InfluenzaA__ACX31907__NA

SEQ ID NO: 19876 - RNA, 1410 nt, Artificial Sequence; identical to SEQ ID NO: 16318
  derived and/or modified CDS sequence (AUadapt) from InfluenzaA__ACX31908__NA

SEQ ID NO: 19877 - RNA, 1410 nt, Artificial Sequence; identical to SEQ ID NO: 19295
  derived and/or modified CDS sequence (AUadapt) from InfluenzaA__ACX31909__NA

SEQ ID NO: 19878 - RNA, 1410 nt, Artificial Sequence; identical to SEQ ID NO: 16318
  derived and/or modified CDS sequence (AUadapt) from InfluenzaA__ACX31911__NA

SEQ ID NO: 19879 - RNA, 1410 nt, Artificial Sequence; identical to SEQ ID NO: 16318
  derived and/or modified CDS sequence (AUadapt) from InfluenzaA__ACX31912__NA

SEQ ID NO: 19880 - RNA, 1410 nt, Artificial Sequence; identical to SEQ ID NO: 16318
  derived and/or modified CDS sequence (AUadapt) from InfluenzaA__ACX31913__NA

SEQ ID NO: 19881 - RNA, 1410 nt, Artificial Sequence; identical to SEQ ID NO: 16318
  derived and/or modified CDS sequence (AUadapt) from InfluenzaA__ACX31914__NA

SEQ ID NO: 19882 - RNA, 1410 nt, Artificial Sequence; identical to SEQ ID NO: 16318
  derived and/or modified CDS sequence (AUadapt) from InfluenzaA__ACX31915__NA

SEQ ID NO: 19883 - RNA, 1410 nt, Artificial Sequence; identical to SEQ ID NO: 16318
  derived and/or modified CDS sequence (AUadapt) from InfluenzaA__ACX31916__NA

SEQ ID NO: 19884 - RNA, 1410 nt, Artificial Sequence
  derived and/or modified CDS sequence (AUadapt) from InfluenzaA__ACX31917__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucacggaccggucccccuaccgcacccugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 19885 - RNA, 1410 nt, Artificial Sequence; identical to SEQ ID NO: 16318
  derived and/or modified CDS sequence (AUadapt) from InfluenzaA__ACX31918__NA

SEQ ID NO: 19886 - RNA, 1410 nt, Artificial Sequence; identical to SEQ ID NO: 16318
  derived and/or modified CDS sequence (AUadapt) from InfluenzaA__ACX31919__NA

SEQ ID NO: 19887 - RNA, 1410 nt, Artificial Sequence; identical to SEQ ID NO: 16318
  derived and/or modified CDS sequence (AUadapt) from InfluenzaA__ACX31920__NA

SEQ ID NO: 19888 - RNA, 1410 nt, Artificial Sequence; identical to SEQ ID NO: 19494
  derived and/or modified CDS sequence (AUadapt) from InfluenzaA__ACX31922__NA

SEQ ID NO: 19889 - RNA, 1410 nt, Artificial Sequence; identical to SEQ ID NO: 16318
  derived and/or modified CDS sequence (AUadapt) from InfluenzaA__ACX31923__NA

SEQ ID NO: 19890 - RNA, 1410 nt, Artificial Sequence; identical to SEQ ID NO: 16274
  derived and/or modified CDS sequence (AUadapt) from InfluenzaA__ACX31924__NA

SEQ ID NO: 19891 - RNA, 1410 nt, Artificial Sequence
  derived and/or modified CDS sequence (AUadapt) from InfluenzaA__ACX31925__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucacccucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucaucaucgacaaguga

SEQ ID NO: 19892 - RNA, 1410 nt, Artificial Sequence; identical to SEQ ID NO: 16318
  derived and/or modified CDS sequence (AUadapt) from InfluenzaA__ACX31926__NA

SEQ ID NO: 19893 - RNA, 1410 nt, Artificial Sequence; identical to SEQ ID NO: 16318
  derived and/or modified CDS sequence (AUadapt) from InfluenzaA__ACX31927__NA

SEQ ID NO: 19894 - RNA, 1410 nt, Artificial Sequence
  derived and/or modified CDS sequence (AUadapt) from InfluenzaA__ACX31928__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggagaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacggggacaccgucggcuggagcuggcccgacggcgccgagcugccguucacgaucgacaaguga

SEQ ID NO: 19895 - RNA, 1410 nt, Artificial Sequence; identical to SEQ ID NO: 19170
  derived and/or modified CDS sequence (AUadapt) from InfluenzaA__ACX31929__NA

SEQ ID NO: 19896 - RNA, 1410 nt, Artificial Sequence; identical to SEQ ID NO: 19494
  derived and/or modified CDS sequence (AUadapt) from InfluenzaA__ACX31930__NA

SEQ ID NO: 19897 - RNA, 1410 nt, Artificial Sequence; identical to SEQ ID NO: 16318
  derived and/or modified CDS sequence (AUadapt) from InfluenzaA__ACX31931__NA

SEQ ID NO: 19898 - RNA, 1410 nt, Artificial Sequence; identical to SEQ ID NO: 16318
  derived and/or modified CDS sequence (AUadapt) from InfluenzaA__ACX31932__NA

SEQ ID NO: 19899 - RNA, 1410 nt, Artificial Sequence; identical to SEQ ID NO: 16318
  derived and/or modified CDS sequence (AUadapt) from InfluenzaA__ACX35250__NA

SEQ ID NO: 19900 - RNA, 1410 nt, Artificial Sequence; identical to SEQ ID NO: 16318
  derived and/or modified CDS sequence (AUadapt) from InfluenzaA__ACX35260__NA

SEQ ID NO: 19901 - RNA, 1410 nt, Artificial Sequence; identical to SEQ ID NO: 16318
  derived and/or modified CDS sequence (AUadapt) from InfluenzaA__ACX35270__NA

SEQ ID NO: 19902 - RNA, 1410 nt, Artificial Sequence
  derived and/or modified CDS sequence (AUadapt) from InfluenzaA__ACX35280__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggacaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19903 - RNA, 1410 nt, Artificial Sequence; identical to SEQ ID NO: 16318
  derived and/or modified CDS sequence (AUadapt) from InfluenzaA__ACX35290__NA

SEQ ID NO: 19904 - RNA, 1410 nt, Artificial Sequence; identical to SEQ ID NO: 16318
  derived and/or modified CDS sequence (AUadapt) from InfluenzaA__ACX35300__NA

SEQ ID NO: 19905 - RNA, 1410 nt, Artificial Sequence
  derived and/or modified CDS sequence (AUadapt) from InfluenzaA__ACX35310__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucucgaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 19906 - RNA, 1410 nt, Artificial Sequence; identical to SEQ ID NO: 16318
  derived and/or modified CDS sequence (AUadapt) from InfluenzaA__ACX35320__NA

SEQ ID NO: 19907 - RNA, 1410 nt, Artificial Sequence
  derived and/or modified CDS sequence (AUadapt) from InfluenzaA__ACX35330__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19908 - RNA, 1410 nt, Artificial Sequence; identical to SEQ ID NO: 16318
  derived and/or modified CDS sequence (AUadapt) from InfluenzaA__ACX48479__NA

SEQ ID NO: 19909 - RNA, 1410 nt, Artificial Sequence; identical to SEQ ID NO: 16318
  derived and/or modified CDS sequence (AUadapt) from InfluenzaA__ACX48481__NA

SEQ ID NO: 19910 - RNA, 1410 nt, Artificial Sequence; identical to SEQ ID NO: 16318
  derived and/or modified CDS sequence (AUadapt) from InfluenzaA__ACX55836__NA

SEQ ID NO: 19911 - RNA, 1410 nt, Artificial Sequence
  derived and/or modified CDS sequence (AUadapt) from InfluenzaA__ACX56269__NA
augaaccccaagcagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19912 - RNA, 1410 nt, Artificial Sequence
  derived and/or modified CDS sequence (AUadapt) from InfluenzaA__ACX56270__NA
augaaccccaagcagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacuccgucagcugguccuggcccgacggggccgagcugccguucaccaucgacaaguga

SEQ ID NO: 19913 - RNA, 1410 nt, Artificial Sequence
  derived and/or modified CDS sequence (AUadapt) from InfluenzaA__ACX56271__NA
augaaccccaagcagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagucggucggguccgugaagcucgccggcaacagcucccugugcccggugagcggcugggccaucuacuccaaggacaacagcauccgcaucggguccaagggcgacgucuucgugauccgggagcccuucaucucgugcagcccccuggagugccgcaccuucuuccucacccagggggcccugcugaacgacaagcacuccaacggcaccaucaaggaccggucccccuaccgcacgcucaugagcugcccgaucggggaggugcccucccccuacaacucgcgguucgagagcgucgccugguccgcgagcgccugccacgacggcaucaacuggcugaccaucggcaucuccgggcccgacaacggcgccguggccgugcugaaguacaacgggaucaucaccgacaccaucaagagcuggcgcaacaacauccuccggacgcaggaguccgagugcgcgugcgucaacggcucgugcuucaccgugaugaccgacggcccguccgacgggcaggccagcuacaagaucuuccgcaucgagaagggcaagaucgugaaguccgucgagaugaacgcccccaacuaccacuacgaggagugcagcugcuaccccgacuccucggagaucacgugcgugugccgggacaacuggcacggguccaaccgccccugggugagcuucaaccagaaccuggaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagucgaucagcucccggaacggguucgagaugaucugggaccccaacggcuggaccgggaccgacaacaacuucagcaucaagcaggacaucgucggcaucaacgagugguccggguacucgggcuccuucgugcagcacccggagcugacgggccucgacugcauccgccccugcuucuggguggagcugauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 19914 - RNA, 1410 nt, Artificial Sequence; identical to SEQ ID NO: 16318
  derived and/or modified CDS sequence (AUadapt) from InfluenzaA__ACX83579__NA

SEQ ID NO: 19915 - RNA, 1410 nt, Artificial Sequence; identical to SEQ ID NO: 16318
  derived and/or modified CDS sequence (AUadapt) from InfluenzaA__ACX85425__NA

SEQ ID NO: 19916 - RNA, 1410 nt, Artificial Sequence; identical to SEQ ID NO: 16318
  derived and/or modified CDS sequence (AUadapt) from InfluenzaA__ACX85426__NA

SEQ ID NO: 19917 - RNA, 1410 nt, Artificial Sequence
  derived and/or modified CDS sequence (AUadapt) from InfluenzaA__ACY02998__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccaacggccaggccagcuacaagaucuuccgcaucgagaaggggaagaucgucaaguccguggagaugaacgcccccaacuaccacuacgaggagugcucgugcuaccccgacuccggcgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucucguucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 19918 - RNA, 1410 nt, Artificial Sequence; identical to SEQ ID NO: 16318
  derived and/or modified CDS sequence (AUadapt) from InfluenzaA__ACY03005__NA

SEQ ID NO: 19919 - RNA, 1410 nt, Artificial Sequence; identical to SEQ ID NO: 16318
  derived and/or modified CDS sequence (AUadapt) from InfluenzaA__ACY03008__NA

SEQ ID NO: 19920 - RNA, 1410 nt, Artificial Sequence; identical to SEQ ID NO: 16318
  derived and/or modified CDS sequence (AUadapt) from InfluenzaA__ACY03011__NA

SEQ ID NO: 19921 - RNA, 1410 nt, Artificial Sequence; identical to SEQ ID NO: 16318
  derived and/or modified CDS sequence (AUadapt) from InfluenzaA__ACY03012__NA

SEQ ID NO: 19922 - RNA, 1410 nt, Artificial Sequence; identical to SEQ ID NO: 16318
  derived and/or modified CDS sequence (AUadapt) from InfluenzaA__ACY03016__NA

SEQ ID NO: 19923 - RNA, 1410 nt, Artificial Sequence; identical to SEQ ID NO: 16318
  derived and/or modified CDS sequence (AUadapt) from InfluenzaA__ACY26194__NA

SEQ ID NO: 19924 - RNA, 1410 nt, Artificial Sequence; identical to SEQ ID NO: 16318
  derived and/or modified CDS sequence (AUadapt) from InfluenzaA__ACY26204__NA

SEQ ID NO: 19925 - RNA, 1410 nt, Artificial Sequence; identical to SEQ ID NO: 16318
  derived and/or modified CDS sequence (AUadapt) from InfluenzaA__ACY30123__NA

SEQ ID NO: 19926 - RNA, 1410 nt, Artificial Sequence; identical to SEQ ID NO: 16318
  derived and/or modified CDS sequence (AUadapt) from InfluenzaA__ACY30124__NA

SEQ ID NO: 19927 - RNA, 1410 nt, Artificial Sequence; identical to SEQ ID NO: 16318
  derived and/or modified CDS sequence (AUadapt) from InfluenzaA__ACY30125__NA

SEQ ID NO: 19928 - RNA, 1410 nt, Artificial Sequence; identical to SEQ ID NO: 16318
  derived and/or modified CDS sequence (AUadapt) from InfluenzaA__ACY30127__NA

SEQ ID NO: 19929 - RNA, 1410 nt, Artificial Sequence; identical to SEQ ID NO: 16318
  derived and/or modified CDS sequence (AUadapt) from InfluenzaA__ACY30128__NA

SEQ ID NO: 19930 - RNA, 1410 nt, Artificial Sequence; identical to SEQ ID NO: 16318
  derived and/or modified CDS sequence (AUadapt) from InfluenzaA__ACY46105__NA

SEQ ID NO: 19931 - RNA, 1410 nt, Artificial Sequence; identical to SEQ ID NO: 16318
  derived and/or modified CDS sequence (AUadapt) from InfluenzaA__ACY46165__NA

SEQ ID NO: 19932 - RNA, 1410 nt, Artificial Sequence; identical to SEQ ID NO: 16318
  derived and/or modified CDS sequence (AUadapt) from InfluenzaA__ACY46175__NA

SEQ ID NO: 19933 - RNA, 1410 nt, Artificial Sequence; identical to SEQ ID NO: 16318
  derived and/or modified CDS sequence (AUadapt) from InfluenzaA__ACY46345__NA

SEQ ID NO: 19934 - RNA, 1410 nt, Artificial Sequence; identical to SEQ ID NO: 16318
  derived and/or modified CDS sequence (AUadapt) from InfluenzaA__ACY46385__NA

SEQ ID NO: 19935 - RNA, 1410 nt, Artificial Sequence; identical to SEQ ID NO: 16318
  derived and/or modified CDS sequence (AUadapt) from InfluenzaA__ACY46485__NA

SEQ ID NO: 19936 - RNA, 1410 nt, Artificial Sequence; identical to SEQ ID NO: 19170
  derived and/or modified CDS sequence (AUadapt) from InfluenzaA__ACY77536__NA

SEQ ID NO: 19937 - RNA, 1410 nt, Artificial Sequence; identical to SEQ ID NO: 16274
  derived and/or modified CDS sequence (AUadapt) from InfluenzaA__ACY77546__NA

SEQ ID NO: 19938 - RNA, 1410 nt, Artificial Sequence; identical to SEQ ID NO: 19170
  derived and/or modified CDS sequence (AUadapt) from InfluenzaA__ACY77565__NA

SEQ ID NO: 19939 - RNA, 1410 nt, Artificial Sequence
  derived and/or modified CDS sequence (AUadapt) from InfluenzaA__ACY77575__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccucggacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 19940 - RNA, 1410 nt, Artificial Sequence; identical to SEQ ID NO: 16318
  derived and/or modified CDS sequence (AUadapt) from InfluenzaA__ACY77585__NA

SEQ ID NO: 19941 - RNA, 1410 nt, Artificial Sequence; identical to SEQ ID NO: 19170
  derived and/or modified CDS sequence (AUadapt) from InfluenzaA__ACY77595__NA

SEQ ID NO: 19942 - RNA, 1410 nt, Artificial Sequence; identical to SEQ ID NO: 19170
  derived and/or modified CDS sequence (AUadapt) from InfluenzaA__ACY77605__NA

SEQ ID NO: 19943 - RNA, 1410 nt, Artificial Sequence; identical to SEQ ID NO: 16318
  derived and/or modified CDS sequence (AUadapt) from InfluenzaA__ACY77625__NA

SEQ ID NO: 19944 - RNA, 1410 nt, Artificial Sequence
  derived and/or modified CDS sequence (AUadapt) from InfluenzaA__ACY77655__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccuucaacggggccaacggcgucaagggguucagcuucaaguacggcaacgggguguggaucggccgcaccaaguccaucagcucgcggaacggcuucgagaugaucugggaccccaacggguggaccggcaccgacaacaacuucuccaucaagcaggacaucguggggaucaacgaguggagcggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 19945 - RNA, 1410 nt, Artificial Sequence; identical to SEQ ID NO: 16318
  derived and/or modified CDS sequence (AUadapt) from InfluenzaA__ACY77665__NA

SEQ ID NO: 19946 - RNA, 1410 nt, Artificial Sequence; identical to SEQ ID NO: 16318
  derived and/or modified CDS sequence (AUadapt) from InfluenzaA__ACY77675__NA

SEQ ID NO: 19947 - RNA, 1410 nt, Artificial Sequence; identical to SEQ ID NO: 16274
  derived and/or modified CDS sequence (AUadapt) from InfluenzaA__ACY77685__NA

SEQ ID NO: 19948 - RNA, 1410 nt, Artificial Sequence; identical to SEQ ID NO: 16274
  derived and/or modified CDS sequence (AUadapt) from InfluenzaA__ACY77695__NA

SEQ ID NO: 19949 - RNA, 1410 nt, Artificial Sequence; identical to SEQ ID NO: 16274
  derived and/or modified CDS sequence (AUadapt) from InfluenzaA__ACY77705__NA

SEQ ID NO: 19950 - RNA, 1410 nt, Artificial Sequence; identical to SEQ ID NO: 16274
  derived and/or modified CDS sequence (AUadapt) from InfluenzaA__ACY77725__NA

SEQ ID NO: 19951 - RNA, 1410 nt, Artificial Sequence; identical to SEQ ID NO: 16274
  derived and/or modified CDS sequence (AUadapt) from InfluenzaA__ACY77735__NA

SEQ ID NO: 19952 - RNA, 1410 nt, Artificial Sequence; identical to SEQ ID NO: 16318
  derived and/or modified CDS sequence (AUadapt) from InfluenzaA__ACY77745__NA

SEQ ID NO: 19953 - RNA, 1410 nt, Artificial Sequence; identical to SEQ ID NO: 16318
  derived and/or modified CDS sequence (AUadapt) from InfluenzaA__ACY77755__NA

SEQ ID NO: 19954 - RNA, 1410 nt, Artificial Sequence; identical to SEQ ID NO: 16318
  derived and/or modified CDS sequence (AUadapt) from InfluenzaA__ACY77775__NA

SEQ ID NO: 19955 - RNA, 1410 nt, Artificial Sequence; identical to SEQ ID NO: 16318
  derived and/or modified CDS sequence (AUadapt) from InfluenzaA__ACY77785__NA

SEQ ID NO: 19956 - RNA, 1410 nt, Artificial Sequence; identical to SEQ ID NO: 16318
  derived and/or modified CDS sequence (AUadapt) from InfluenzaA__ACY77795__NA

SEQ ID NO: 19957 - RNA, 1410 nt, Artificial Sequence
  derived and/or modified CDS sequence (AUadapt) from InfluenzaA__ACY77825__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgccaagcuggccgggaacagcucccucugcccggugagcggcugggccaucuacuccaaggacaacagcauccgcaucggcuccaagggggacgucuucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacucgcgguucgagagcgucgcgugguccgccagcgccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagucgaucaacagccggaacggcuucgagaugaucugggaccccaacggguggaccggcaccgacaacaacuucuccaucaagcaggacaucgucgggaucaacgaguggagcggcuacuccgggucguucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgcggagcugccguucacgaucgacaaguga

SEQ ID NO: 19958 - RNA, 1410 nt, Artificial Sequence; identical to SEQ ID NO: 19957
  derived and/or modified CDS sequence (AUadapt) from InfluenzaA__ACY77835__NA

SEQ ID NO: 19959 - RNA, 1410 nt, Artificial Sequence; identical to SEQ ID NO: 19170
  derived and/or modified CDS sequence (AUadapt) from InfluenzaA__ACY77845__NA

SEQ ID NO: 19960 - RNA, 1410 nt, Artificial Sequence; identical to SEQ ID NO: 16318
  derived and/or modified CDS sequence (AUadapt) from InfluenzaA__ACY77865__NA

SEQ ID NO: 19961 - RNA, 1410 nt, Artificial Sequence
  derived and/or modified CDS sequence (AUadapt) from InfluenzaA__ACY77870__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19962 - RNA, 1410 nt, Artificial Sequence; identical to SEQ ID NO: 16318
  derived and/or modified CDS sequence (AUadapt) from InfluenzaA__ACY77877__NA

SEQ ID NO: 19963 - RNA, 1410 nt, Artificial Sequence; identical to SEQ ID NO: 16318
  derived and/or modified CDS sequence (AUadapt) from InfluenzaA__ACY77887__NA

SEQ ID NO: 19964 - RNA, 1410 nt, Artificial Sequence; identical to SEQ ID NO: 16318
  derived and/or modified CDS sequence (AUadapt) from InfluenzaA__ACY77907__NA

SEQ ID NO: 19965 - RNA, 1410 nt, Artificial Sequence; identical to SEQ ID NO: 19170
  derived and/or modified CDS sequence (AUadapt) from InfluenzaA__ACY77917__NA

SEQ ID NO: 19966 - RNA, 1410 nt, Artificial Sequence
  derived and/or modified CDS sequence (AUadapt) from InfluenzaA__ACY77927__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccaacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 19967 - RNA, 1410 nt, Artificial Sequence; identical to SEQ ID NO: 16318
  derived and/or modified CDS sequence (AUadapt) from InfluenzaA__ACY77937__NA

SEQ ID NO: 19968 - RNA, 1410 nt, Artificial Sequence; identical to SEQ ID NO: 16318
  derived and/or modified CDS sequence (AUadapt) from InfluenzaA__ACY77947__NA

SEQ ID NO: 19969 - RNA, 1410 nt, Artificial Sequence; identical to SEQ ID NO: 16318
  derived and/or modified CDS sequence (AUadapt) from InfluenzaA__ACY77967__NA

SEQ ID NO: 19970 - RNA, 1410 nt, Artificial Sequence; identical to SEQ ID NO: 16274
  derived and/or modified CDS sequence (AUadapt) from InfluenzaA__ACY77977__NA

SEQ ID NO: 19971 - RNA, 1410 nt, Artificial Sequence; identical to SEQ ID NO: 16318
  derived and/or modified CDS sequence (AUadapt) from InfluenzaA__ACY77987__NA

SEQ ID NO: 19972 - RNA, 1410 nt, Artificial Sequence
  derived and/or modified CDS sequence (AUadapt) from InfluenzaA__ACY77997__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugacccuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 19973 - RNA, 1410 nt, Artificial Sequence; identical to SEQ ID NO: 16318
  derived and/or modified CDS sequence (AUadapt) from InfluenzaA__ACY78017__NA

SEQ ID NO: 19974 - RNA, 1410 nt, Artificial Sequence
  derived and/or modified CDS sequence (AUadapt) from InfluenzaA__ACZ01955__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgggaacggcgccguggccguccugaaguacaacgggaucaucaccgacaccaucaagagcuggcgcaacaacauccugcggacgcaggaguccgagugcgcgugcgugaacggcucgugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucucgaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 19975 - RNA, 1410 nt, Artificial Sequence; identical to SEQ ID NO: 16318
  derived and/or modified CDS sequence (AUadapt) from InfluenzaA__ACZ05053__NA

SEQ ID NO: 19976 - RNA, 1410 nt, Artificial Sequence; identical to SEQ ID NO: 16274
  derived and/or modified CDS sequence (AUadapt) from InfluenzaA__ACZ05064__NA

SEQ ID NO: 19977 - RNA, 1410 nt, Artificial Sequence; identical to SEQ ID NO: 16318
  derived and/or modified CDS sequence (AUadapt) from InfluenzaA__ACZ05074__NA

SEQ ID NO: 19978 - RNA, 1410 nt, Artificial Sequence; identical to SEQ ID NO: 16318
  derived and/or modified CDS sequence (AUadapt) from InfluenzaA__ACZ05084__NA

SEQ ID NO: 19979 - RNA, 1410 nt, Artificial Sequence; identical to SEQ ID NO: 16318
  derived and/or modified CDS sequence (AUadapt) from InfluenzaA__ACZ05094__NA

SEQ ID NO: 19980 - RNA, 1410 nt, Artificial Sequence; identical to SEQ ID NO: 16318
  derived and/or modified CDS sequence (AUadapt) from InfluenzaA__ACZ05104__NA

SEQ ID NO: 19981 - RNA, 1410 nt, Artificial Sequence; identical to SEQ ID NO: 16318
  derived and/or modified CDS sequence (AUadapt) from InfluenzaA__ACZ05114__NA

SEQ ID NO: 19982 - RNA, 1410 nt, Artificial Sequence; identical to SEQ ID NO: 16318
  derived and/or modified CDS sequence (AUadapt) from InfluenzaA__ACZ05124__NA

SEQ ID NO: 19983 - RNA, 1410 nt, Artificial Sequence; identical to SEQ ID NO: 16318
  derived and/or modified CDS sequence (AUadapt) from InfluenzaA__ACZ05144__NA

SEQ ID NO: 19984 - RNA, 1410 nt, Artificial Sequence; identical to SEQ ID NO: 16318
  derived and/or modified CDS sequence (AUadapt) from InfluenzaA__ACZ05154__NA

SEQ ID NO: 19985 - RNA, 1410 nt, Artificial Sequence; identical to SEQ ID NO: 19001
  derived and/or modified CDS sequence (AUadapt) from InfluenzaA__ACZ05164__NA

SEQ ID NO: 19986 - RNA, 1410 nt, Artificial Sequence; identical to SEQ ID NO: 19001
  derived and/or modified CDS sequence (AUadapt) from InfluenzaA__ACZ05175__NA

SEQ ID NO: 19987 - RNA, 1413 nt, Artificial Sequence
  derived and/or modified CDS sequence (AUadapt) from InfluenzaA__ACZ05197__NA
augaaccccaaccagaagaucaugaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 19988 - RNA, 1410 nt, Artificial Sequence
  derived and/or modified CDS sequence (AUadapt) from InfluenzaA__ACZ05208__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugcagcgaccccaacaacgaggagggcgggcacggggucaagggcugggccuucgacuccgggaacgacguguggaugggccgcaccaucucggagaagucccggcucggcuacgagaccuucaaggucaucgagggguggagcaaccccaaguccaagcugcagaucaaccgccaggugaucguggaccggggcaaccgcucgggguacagcggcaucuucuccgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 19989 - RNA, 1410 nt, Artificial Sequence
  derived and/or modified CDS sequence (AUadapt) from InfluenzaA__ACZ05219__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgggaucaccggcuucgcgcccuucuccaaggacaacagcauccgccuguccgccgggggcgacaucugggucacccgggagcccuacgugucgugcgaccccgacaagugcuaccaguucgcccucgggcagggcaccacgcugaacaacgugcacuccaacaacaccguccgcgaccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 19990 - RNA, 1410 nt, Artificial Sequence; identical to SEQ ID NO: 19001
  derived and/or modified CDS sequence (AUadapt) from InfluenzaA__ACZ05230__NA

SEQ ID NO: 19991 - RNA, 1410 nt, Artificial Sequence
  derived and/or modified CDS sequence (AUadapt) from InfluenzaA__ACZ05241__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcaagcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 19992 - RNA, 1413 nt, Artificial Sequence
  derived and/or modified CDS sequence (AUadapt) from InfluenzaA__ACZ05296__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccgguggcgguggacggcgccaacggggucaagggcuucagcuacaaguacggcaacgggguguggaucggccgcaccaaguccaaccggcugcgcaagggguucgagaugaucugggaccccaacggcuggacgaacaccgacucggacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccucgggcuccagcaucuccuucugcggggucaacagcgacaccgccaacugguccuggcccgacggcgccgagcugcccuucacgaucgacaaguga

SEQ ID NO: 19993 - RNA, 1410 nt, Artificial Sequence; identical to SEQ ID NO: 19001
  derived and/or modified CDS sequence (AUadapt) from InfluenzaA__ACZ05307__NA

SEQ ID NO: 19994 - RNA, 1410 nt, Artificial Sequence
  derived and/or modified CDS sequence (AUadapt) from InfluenzaA__ACZ05318__NA
augaaccccaaccagaagaucaucaccaucggcucggugucccugaccaucucgacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccaucuga

SEQ ID NO: 19995 - RNA, 1410 nt, Artificial Sequence; identical to SEQ ID NO: 19001
  derived and/or modified CDS sequence (AUadapt) from InfluenzaA__ACZ05329__NA

SEQ ID NO: 19996 - RNA, 1410 nt, Artificial Sequence; identical to SEQ ID NO: 18914
  derived and/or modified CDS sequence (AUadapt) from InfluenzaA__ACZ05340__NA

SEQ ID NO: 19997 - RNA, 1410 nt, Artificial Sequence; identical to SEQ ID NO: 19991
  derived and/or modified CDS sequence (AUadapt) from InfluenzaA__ACZ05362__NA

SEQ ID NO: 19998 - RNA, 1410 nt, Artificial Sequence; identical to SEQ ID NO: 19001
  derived and/or modified CDS sequence (AUadapt) from InfluenzaA__ACZ05373__NA

SEQ ID NO: 19999 - RNA, 1410 nt, Artificial Sequence; identical to SEQ ID NO: 19001
  derived and/or modified CDS sequence (AUadapt) from InfluenzaA__ACZ05395__NA

SEQ ID NO: 20000 - RNA, 1410 nt, Artificial Sequence; identical to SEQ ID NO: 19001
  derived and/or modified CDS sequence (AUadapt) from InfluenzaA__ACZ05406__NA

SEQ ID NO: 20001 - RNA, 1413 nt, Artificial Sequence
  derived and/or modified CDS sequence (AUadapt) from InfluenzaA__ACZ05450__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcgugcggaucggguccaagggcgacguguucgucauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcggucgccgugcugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggucaccaaguccaucgagcucaacgcccccaacuucuacuacgaggagugcagcugcuacccggacaccggcaucgugaugugcgugugccgggacaacuggcacggguccaaccgccccugggucucguucaaccagaaccuggacuaccagaucggcuacaucugcuccggcguguucggggacaacccccggcccgaggacggcgaggggagcugcaacccggugaccgucgacggcgcgaacggggugaagggcuucuccuacaaguacggcaacgggguguggaucggccgcaccaagagcaaccggcugcgcaagggguucgagaugaucugggaccccaacggcuggacgaacaccgacuccgacuucucggucaagcaggacgugguggccaucaccgacuggagcggguacuccggcagcuucguccagcaccccgagcucacgggccuggacugcauccggcccugcuucuggguggagcugguccgcgggcucccgcgggagaacaccaccaucuggaccuccggcucguccaucagcuucugcggggugaacuccgacacggccaacuggagcuggcccgacggcgccgagcugcccuucaccaucgacaaguga

SEQ ID NO: 20002 - RNA, 1410 nt, Artificial Sequence; identical to SEQ ID NO: 19001
  derived and/or modified CDS sequence (AUadapt) from InfluenzaA__ACZ05461__NA

SEQ ID NO: 20003 - RNA, 1410 nt, Artificial Sequence; identical to SEQ ID NO: 19001
  derived and/or modified CDS sequence (AUadapt) from InfluenzaA__ACZ05472__NA

SEQ ID NO: 20004 - RNA, 1410 nt, Artificial Sequence
  derived and/or modified CDS sequence (AUadapt) from InfluenzaA__ACZ05483__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 20005 - RNA, 1410 nt, Artificial Sequence; identical to SEQ ID NO: 19001
  derived and/or modified CDS sequence (AUadapt) from InfluenzaA__ACZ05494__NA

SEQ ID NO: 20006 - RNA, 1410 nt, Artificial Sequence; identical to SEQ ID NO: 19994
  derived and/or modified CDS sequence (AUadapt) from InfluenzaA__ACZ05516__NA

SEQ ID NO: 20007 - RNA, 1410 nt, Artificial Sequence
  derived and/or modified CDS sequence (AUadapt) from InfluenzaA__ACZ05527__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugcucggaccccaacaacgaggagggcgggcacggggucaagggcugggccuucgacgacgggaacgacguguggaugggccgcaccaucuccgagaagucccggcucggcuacgagaccuucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 20008 - RNA, 1410 nt, Artificial Sequence; identical to SEQ ID NO: 19991
  derived and/or modified CDS sequence (AUadapt) from InfluenzaA__ACZ05538__NA

SEQ ID NO: 20009 - RNA, 1413 nt, Artificial Sequence; identical to SEQ ID NO: 19863
  derived and/or modified CDS sequence (AUadapt) from InfluenzaA__ACZ05593__NA

SEQ ID NO: 20010 - RNA, 1413 nt, Artificial Sequence
  derived and/or modified CDS sequence (AUadapt) from InfluenzaA__ACZ05604__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccauccggggcugggccaucuacaccaaggacaacagcauccgcaucggguccaagggcgacguguucgugauccgggagccguucaucucgugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggucgugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucucggugaagcaggacgucguggccaucaccgacugguccggguacagcggcagcuucgugcagcaccccgagcucacgggccuggacugcauccgccccugcuucugggucgagcuggugcgggggcucccgcgcgagaacaccaccaucuggaccuccggcucguccaucagcuucugcggggucaacuccgacacggccaacuggagcuggcccgacggcgccgagcugcccuucaccaucgacaaguga

SEQ ID NO: 20011 - RNA, 1410 nt, Artificial Sequence; identical to SEQ ID NO: 19001
  derived and/or modified CDS sequence (AUadapt) from InfluenzaA__ACZ05953__NA

SEQ ID NO: 20012 - RNA, 1410 nt, Artificial Sequence; identical to SEQ ID NO: 20007
  derived and/or modified CDS sequence (AUadapt) from InfluenzaA__ACZ05964__NA

SEQ ID NO: 20013 - RNA, 1410 nt, Artificial Sequence; identical to SEQ ID NO: 19001
  derived and/or modified CDS sequence (AUadapt) from InfluenzaA__ACZ05997__NA

SEQ ID NO: 20014 - RNA, 1410 nt, Artificial Sequence; identical to SEQ ID NO: 20007
  derived and/or modified CDS sequence (AUadapt) from InfluenzaA__ACZ06008__NA

SEQ ID NO: 20015 - RNA, 1410 nt, Artificial Sequence; identical to SEQ ID NO: 20007
  derived and/or modified CDS sequence (AUadapt) from InfluenzaA__ACZ06019__NA

SEQ ID NO: 20016 - RNA, 1413 nt, Artificial Sequence
  derived and/or modified CDS sequence (AUadapt) from InfluenzaA__ACZ16015__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugagcaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucaccggccuggacugcauccggcccugcuucugggucgagcuggugcgcgggcucccgcgggagaacacgaccaucuggaccuccggcucguccaucagcuucugcggggucaacuccgacaccgccaacuggagcuggcccgacggcgccgagcugcccuucacgaucgacaaguga

SEQ ID NO: 20017 - RNA, 1413 nt, Artificial Sequence
  derived and/or modified CDS sequence (AUadapt) from InfluenzaA__ACZ16025__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccaucaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccgaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 20018 - RNA, 1413 nt, Artificial Sequence; identical to SEQ ID NO: 19863
  derived and/or modified CDS sequence (AUadapt) from InfluenzaA__ACZ16035__NA

SEQ ID NO: 20019 - RNA, 1410 nt, Artificial Sequence
  derived and/or modified CDS sequence (AUadapt) from InfluenzaA__ACZ16043__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacaacauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20020 - RNA, 1410 nt, Artificial Sequence
  derived and/or modified CDS sequence (AUadapt) from InfluenzaA__ACZ16053__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcacgaagcaggacaucguggggaucaacgagugguccggcuacucgggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 20021 - RNA, 1410 nt, Artificial Sequence; identical to SEQ ID NO: 16274
  derived and/or modified CDS sequence (AUadapt) from InfluenzaA__ACZ16073__NA

SEQ ID NO: 20022 - RNA, 1410 nt, Artificial Sequence
  derived and/or modified CDS sequence (AUadapt) from InfluenzaA__ACZ16083__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgcgccagagcgucguguccgugaagcuggccggcaacucgucccucugcccggucagcgggugggccaucuacuccaaggacaacagcgugcggaucggcuccaagggcgacguguucgucauccgcgagcccuucaucagcugcagcccccuggggugccggaccuucuuccugacccagggcgcccuccugaacgacaagcacuccaacgggaccaucaaggaccgcucccccuaccggacgcugaugucgugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggucgugcuucaccgucaugaccgacggcccguccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugucguucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggaucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 20023 - RNA, 1410 nt, Artificial Sequence; identical to SEQ ID NO: 16274
  derived and/or modified CDS sequence (AUadapt) from InfluenzaA__ACZ16093__NA

SEQ ID NO: 20024 - RNA, 1410 nt, Artificial Sequence; identical to SEQ ID NO: 16318
  derived and/or modified CDS sequence (AUadapt) from InfluenzaA__ACZ16103__NA

SEQ ID NO: 20025 - RNA, 1410 nt, Artificial Sequence; identical to SEQ ID NO: 16318
  derived and/or modified CDS sequence (AUadapt) from InfluenzaA__ACZ16113__NA

SEQ ID NO: 20026 - RNA, 1410 nt, Artificial Sequence; identical to SEQ ID NO: 16318
  derived and/or modified CDS sequence (AUadapt) from InfluenzaA__ACZ16123__NA

SEQ ID NO: 20027 - RNA, 1410 nt, Artificial Sequence
  derived and/or modified CDS sequence (AUadapt) from InfluenzaA__ACZ16133__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20028 - RNA, 1410 nt, Artificial Sequence
  derived and/or modified CDS sequence (AUadapt) from InfluenzaA__ACZ16143__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggcccccuguccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20029 - RNA, 1410 nt, Artificial Sequence; identical to SEQ ID NO: 16318
  derived and/or modified CDS sequence (AUadapt) from InfluenzaA__ACZ16153__NA

SEQ ID NO: 20030 - RNA, 1410 nt, Artificial Sequence; identical to SEQ ID NO: 16318
  derived and/or modified CDS sequence (AUadapt) from InfluenzaA__ACZ16163__NA

SEQ ID NO: 20031 - RNA, 1410 nt, Artificial Sequence; identical to SEQ ID NO: 16274
  derived and/or modified CDS sequence (AUadapt) from InfluenzaA__ACZ16173__NA

SEQ ID NO: 20032 - RNA, 1410 nt, Artificial Sequence; identical to SEQ ID NO: 16318
  derived and/or modified CDS sequence (AUadapt) from InfluenzaA__ACZ16193__NA

SEQ ID NO: 20033 - RNA, 1410 nt, Artificial Sequence; identical to SEQ ID NO: 16318
  derived and/or modified CDS sequence (AUadapt) from InfluenzaA__ACZ16203__NA

SEQ ID NO: 20034 - RNA, 1410 nt, Artificial Sequence; identical to SEQ ID NO: 16318
  derived and/or modified CDS sequence (AUadapt) from InfluenzaA__ACZ16213__NA

SEQ ID NO: 20035 - RNA, 1410 nt, Artificial Sequence
  derived and/or modified CDS sequence (AUadapt) from InfluenzaA__ACZ16223__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgagaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucaucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 20036 - RNA, 1410 nt, Artificial Sequence; identical to SEQ ID NO: 16318
  derived and/or modified CDS sequence (AUadapt) from InfluenzaA__ACZ16233__NA

SEQ ID NO: 20037 - RNA, 1410 nt, Artificial Sequence; identical to SEQ ID NO: 19848
  derived and/or modified CDS sequence (AUadapt) from InfluenzaA__ACZ16243__NA

SEQ ID NO: 20038 - RNA, 1410 nt, Artificial Sequence
  derived and/or modified CDS sequence (AUadapt) from InfluenzaA__ACZ16253__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaacaucgacaaguga

SEQ ID NO: 20039 - RNA, 1410 nt, Artificial Sequence; identical to SEQ ID NO: 16318
  derived and/or modified CDS sequence (AUadapt) from InfluenzaA__ACZ16263__NA

SEQ ID NO: 20040 - RNA, 1410 nt, Artificial Sequence; identical to SEQ ID NO: 16274
  derived and/or modified CDS sequence (AUadapt) from InfluenzaA__ACZ16283__NA

SEQ ID NO: 20041 - RNA, 1410 nt, Artificial Sequence; identical to SEQ ID NO: 16318
  derived and/or modified CDS sequence (AUadapt) from InfluenzaA__ACZ16293__NA

SEQ ID NO: 20042 - RNA, 1410 nt, Artificial Sequence; identical to SEQ ID NO: 16318
  derived and/or modified CDS sequence (AUadapt) from InfluenzaA__ACZ16303__NA

SEQ ID NO: 20043 - RNA, 1410 nt, Artificial Sequence; identical to SEQ ID NO: 16318
  derived and/or modified CDS sequence (AUadapt) from InfluenzaA__ACZ16313__NA

SEQ ID NO: 20044 - RNA, 1410 nt, Artificial Sequence; identical to SEQ ID NO: 16318
  derived and/or modified CDS sequence (AUadapt) from InfluenzaA__ACZ16323__NA

SEQ ID NO: 20045 - RNA, 1410 nt, Artificial Sequence; identical to SEQ ID NO: 16318
  derived and/or modified CDS sequence (AUadapt) from InfluenzaA__ACZ16333__NA

SEQ ID NO: 20046 - RNA, 1410 nt, Artificial Sequence; identical to SEQ ID NO: 19848
  derived and/or modified CDS sequence (AUadapt) from InfluenzaA__ACZ16343__NA

SEQ ID NO: 20047 - RNA, 1410 nt, Artificial Sequence; identical to SEQ ID NO: 16318
  derived and/or modified CDS sequence (AUadapt) from InfluenzaA__ACZ16353__NA

SEQ ID NO: 20048 - RNA, 1410 nt, Artificial Sequence; identical to SEQ ID NO: 16318
  derived and/or modified CDS sequence (AUadapt) from InfluenzaA__ACZ16363__NA

SEQ ID NO: 20049 - RNA, 1410 nt, Artificial Sequence; identical to SEQ ID NO: 16274
  derived and/or modified CDS sequence (AUadapt) from InfluenzaA__ACZ16373__NA

SEQ ID NO: 20050 - RNA, 1410 nt, Artificial Sequence; identical to SEQ ID NO: 16318
  derived and/or modified CDS sequence (AUadapt) from InfluenzaA__ACZ16383__NA

SEQ ID NO: 20051 - RNA, 1410 nt, Artificial Sequence; identical to SEQ ID NO: 16318
  derived and/or modified CDS sequence (AUadapt) from InfluenzaA__ACZ16393__NA

SEQ ID NO: 20052 - RNA, 1410 nt, Artificial Sequence; identical to SEQ ID NO: 16318
  derived and/or modified CDS sequence (AUadapt) from InfluenzaA__ACZ16403__NA

SEQ ID NO: 20053 - RNA, 1410 nt, Artificial Sequence; identical to SEQ ID NO: 16318
  derived and/or modified CDS sequence (AUadapt) from InfluenzaA__ACZ16423__NA

SEQ ID NO: 20054 - RNA, 1410 nt, Artificial Sequence; identical to SEQ ID NO: 16318
  derived and/or modified CDS sequence (AUadapt) from InfluenzaA__ACZ16433__NA

SEQ ID NO: 20055 - RNA, 1410 nt, Artificial Sequence; identical to SEQ ID NO: 16318
  derived and/or modified CDS sequence (AUadapt) from InfluenzaA__ACZ16443__NA

SEQ ID NO: 20056 - RNA, 1410 nt, Artificial Sequence; identical to SEQ ID NO: 16318
  derived and/or modified CDS sequence (AUadapt) from InfluenzaA__ACZ16453__NA

SEQ ID NO: 20057 - RNA, 1410 nt, Artificial Sequence; identical to SEQ ID NO: 19848
  derived and/or modified CDS sequence (AUadapt) from InfluenzaA__ACZ16463__NA

SEQ ID NO: 20058 - RNA, 1410 nt, Artificial Sequence; identical to SEQ ID NO: 16318
  derived and/or modified CDS sequence (AUadapt) from InfluenzaA__ACZ16483__NA

SEQ ID NO: 20059 - RNA, 1410 nt, Artificial Sequence; identical to SEQ ID NO: 16318
  derived and/or modified CDS sequence (AUadapt) from InfluenzaA__ACZ16493__NA

SEQ ID NO: 20060 - RNA, 1410 nt, Artificial Sequence
  derived and/or modified CDS sequence (AUadapt) from InfluenzaA__ACZ16503__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagauggacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20061 - RNA, 1410 nt, Artificial Sequence; identical to SEQ ID NO: 19848
  derived and/or modified CDS sequence (AUadapt) from InfluenzaA__ACZ16513__NA

SEQ ID NO: 20062 - RNA, 1410 nt, Artificial Sequence; identical to SEQ ID NO: 16318
  derived and/or modified CDS sequence (AUadapt) from InfluenzaA__ACZ16523__NA

SEQ ID NO: 20063 - RNA, 1410 nt, Artificial Sequence; identical to SEQ ID NO: 16318
  derived and/or modified CDS sequence (AUadapt) from InfluenzaA__ACZ16533__NA

SEQ ID NO: 20064 - RNA, 1410 nt, Artificial Sequence; identical to SEQ ID NO: 16274
  derived and/or modified CDS sequence (AUadapt) from InfluenzaA__ACZ16543__NA

SEQ ID NO: 20065 - RNA, 1410 nt, Artificial Sequence; identical to SEQ ID NO: 16318
  derived and/or modified CDS sequence (AUadapt) from InfluenzaA__ACZ16553__NA

SEQ ID NO: 20066 - RNA, 1410 nt, Artificial Sequence; identical to SEQ ID NO: 16318
  derived and/or modified CDS sequence (AUadapt) from InfluenzaA__ACZ16586__NA

SEQ ID NO: 20067 - RNA, 1410 nt, Artificial Sequence; identical to SEQ ID NO: 16318
  derived and/or modified CDS sequence (AUadapt) from InfluenzaA__ACZ16596__NA

SEQ ID NO: 20068 - RNA, 1410 nt, Artificial Sequence; identical to SEQ ID NO: 16318
  derived and/or modified CDS sequence (AUadapt) from InfluenzaA__ACZ16606__NA

SEQ ID NO: 20069 - RNA, 1410 nt, Artificial Sequence; identical to SEQ ID NO: 16318
  derived and/or modified CDS sequence (AUadapt) from InfluenzaA__ACZ16633__NA

SEQ ID NO: 20070 - RNA, 1410 nt, Artificial Sequence
  derived and/or modified CDS sequence (AUadapt) from InfluenzaA__ACZ16643__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugcgcuacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 20071 - RNA, 1410 nt, Artificial Sequence; identical to SEQ ID NO: 16318
  derived and/or modified CDS sequence (AUadapt) from InfluenzaA__ACZ16653__NA

SEQ ID NO: 20072 - RNA, 1410 nt, Artificial Sequence; identical to SEQ ID NO: 16318
  derived and/or modified CDS sequence (AUadapt) from InfluenzaA__ACZ16663__NA

SEQ ID NO: 20073 - RNA, 1410 nt, Artificial Sequence; identical to SEQ ID NO: 16318
  derived and/or modified CDS sequence (AUadapt) from InfluenzaA__ACZ16673__NA

SEQ ID NO: 20074 - RNA, 1410 nt, Artificial Sequence; identical to SEQ ID NO: 16318
  derived and/or modified CDS sequence (AUadapt) from InfluenzaA__ACZ16683__NA

SEQ ID NO: 20075 - RNA, 1410 nt, Artificial Sequence; identical to SEQ ID NO: 16318
  derived and/or modified CDS sequence (AUadapt) from InfluenzaA__ACZ16693__NA

SEQ ID NO: 20076 - RNA, 1410 nt, Artificial Sequence; identical to SEQ ID NO: 16318
  derived and/or modified CDS sequence (AUadapt) from InfluenzaA__ACZ16703__NA

SEQ ID NO: 20077 - RNA, 1410 nt, Artificial Sequence; identical to SEQ ID NO: 16318
  derived and/or modified CDS sequence (AUadapt) from InfluenzaA__ACZ16713__NA

SEQ ID NO: 20078 - RNA, 1410 nt, Artificial Sequence; identical to SEQ ID NO: 16318
  derived and/or modified CDS sequence (AUadapt) from InfluenzaA__ACZ16723__NA

SEQ ID NO: 20079 - RNA, 1410 nt, Artificial Sequence; identical to SEQ ID NO: 16318
  derived and/or modified CDS sequence (AUadapt) from InfluenzaA__ACZ16733__NA

SEQ ID NO: 20080 - RNA, 1410 nt, Artificial Sequence; identical to SEQ ID NO: 16318
  derived and/or modified CDS sequence (AUadapt) from InfluenzaA__ACZ16743__NA

SEQ ID NO: 20081 - RNA, 1410 nt, Artificial Sequence; identical to SEQ ID NO: 16318
  derived and/or modified CDS sequence (AUadapt) from InfluenzaA__ACZ16753__NA

SEQ ID NO: 20082 - RNA, 1410 nt, Artificial Sequence; identical to SEQ ID NO: 16318
  derived and/or modified CDS sequence (AUadapt) from InfluenzaA__ACZ16763__NA

SEQ ID NO: 20083 - RNA, 1410 nt, Artificial Sequence; identical to SEQ ID NO: 16274
  derived and/or modified CDS sequence (AUadapt) from InfluenzaA__ACZ16773__NA

SEQ ID NO: 20084 - RNA, 1410 nt, Artificial Sequence; identical to SEQ ID NO: 16318
  derived and/or modified CDS sequence (AUadapt) from InfluenzaA__ACZ16783__NA

SEQ ID NO: 20085 - RNA, 1410 nt, Artificial Sequence; identical to SEQ ID NO: 16318
  derived and/or modified CDS sequence (AUadapt) from InfluenzaA__ACZ16793__NA

SEQ ID NO: 20086 - RNA, 1410 nt, Artificial Sequence; identical to SEQ ID NO: 16318
  derived and/or modified CDS sequence (AUadapt) from InfluenzaA__ACZ16803__NA

SEQ ID NO: 20087 - RNA, 1410 nt, Artificial Sequence; identical to SEQ ID NO: 16318
  derived and/or modified CDS sequence (AUadapt) from InfluenzaA__ACZ16813__NA

SEQ ID NO: 20088 - RNA, 1410 nt, Artificial Sequence; identical to SEQ ID NO: 16274
  derived and/or modified CDS sequence (AUadapt) from InfluenzaA__ACZ16823__NA

SEQ ID NO: 20089 - RNA, 1410 nt, Artificial Sequence; identical to SEQ ID NO: 16318
  derived and/or modified CDS sequence (AUadapt) from InfluenzaA__ACZ16833__NA

SEQ ID NO: 20090 - RNA, 1410 nt, Artificial Sequence; identical to SEQ ID NO: 16318
  derived and/or modified CDS sequence (AUadapt) from InfluenzaA__ACZ16843__NA

SEQ ID NO: 20091 - RNA, 1410 nt, Artificial Sequence; identical to SEQ ID NO: 20060
  derived and/or modified CDS sequence (AUadapt) from InfluenzaA__ACZ16853__NA

SEQ ID NO: 20092 - RNA, 1410 nt, Artificial Sequence; identical to SEQ ID NO: 16318
  derived and/or modified CDS sequence (AUadapt) from InfluenzaA__ACZ16863__NA

SEQ ID NO: 20093 - RNA, 1410 nt, Artificial Sequence; identical to SEQ ID NO: 16318
  derived and/or modified CDS sequence (AUadapt) from InfluenzaA__ACZ16873__NA

SEQ ID NO: 20094 - RNA, 1410 nt, Artificial Sequence; identical to SEQ ID NO: 16318
  derived and/or modified CDS sequence (AUadapt) from InfluenzaA__ACZ16883__NA

SEQ ID NO: 20095 - RNA, 1410 nt, Artificial Sequence; identical to SEQ ID NO: 16318
  derived and/or modified CDS sequence (AUadapt) from InfluenzaA__ACZ16893__NA

SEQ ID NO: 20096 - RNA, 1410 nt, Artificial Sequence; identical to SEQ ID NO: 16318
  derived and/or modified CDS sequence (AUadapt) from InfluenzaA__ACZ16903__NA

SEQ ID NO: 20097 - RNA, 1410 nt, Artificial Sequence; identical to SEQ ID NO: 16318
  derived and/or modified CDS sequence (AUadapt) from InfluenzaA__ACZ16913__NA

SEQ ID NO: 20098 - RNA, 1410 nt, Artificial Sequence; identical to SEQ ID NO: 16318
  derived and/or modified CDS sequence (AUadapt) from InfluenzaA__ACZ16923__NA

SEQ ID NO: 20099 - RNA, 1410 nt, Artificial Sequence; identical to SEQ ID NO: 16318
  derived and/or modified CDS sequence (AUadapt) from InfluenzaA__ACZ16933__NA

SEQ ID NO: 20100 - RNA, 1410 nt, Artificial Sequence; identical to SEQ ID NO: 16318
  derived and/or modified CDS sequence (AUadapt) from InfluenzaA__ACZ16943__NA

SEQ ID NO: 20101 - RNA, 1410 nt, Artificial Sequence; identical to SEQ ID NO: 16274
  derived and/or modified CDS sequence (AUadapt) from InfluenzaA__ACZ16953__NA

SEQ ID NO: 20102 - RNA, 1410 nt, Artificial Sequence; identical to SEQ ID NO: 16318
  derived and/or modified CDS sequence (AUadapt) from InfluenzaA__ACZ16963__NA

SEQ ID NO: 20103 - RNA, 1410 nt, Artificial Sequence; identical to SEQ ID NO: 16318
  derived and/or modified CDS sequence (AUadapt) from InfluenzaA__ACZ16973__NA

SEQ ID NO: 20104 - RNA, 1410 nt, Artificial Sequence; identical to SEQ ID NO: 16318
  derived and/or modified CDS sequence (AUadapt) from InfluenzaA__ACZ16983__NA

SEQ ID NO: 20105 - RNA, 1410 nt, Artificial Sequence; identical to SEQ ID NO: 16318
  derived and/or modified CDS sequence (AUadapt) from InfluenzaA__ACZ16993__NA

SEQ ID NO: 20106 - RNA, 1410 nt, Artificial Sequence; identical to SEQ ID NO: 16318
  derived and/or modified CDS sequence (AUadapt) from InfluenzaA__ACZ17003__NA

SEQ ID NO: 20107 - RNA, 1410 nt, Artificial Sequence; identical to SEQ ID NO: 16318
  derived and/or modified CDS sequence (AUadapt) from InfluenzaA__ACZ17023__NA

SEQ ID NO: 20108 - RNA, 1410 nt, Artificial Sequence; identical to SEQ ID NO: 16318
  derived and/or modified CDS sequence (AUadapt) from InfluenzaA__ACZ17043__NA

SEQ ID NO: 20109 - RNA, 1410 nt, Artificial Sequence; identical to SEQ ID NO: 16318
  derived and/or modified CDS sequence (AUadapt) from InfluenzaA__ACZ17053__NA

SEQ ID NO: 20110 - RNA, 1410 nt, Artificial Sequence
  derived and/or modified CDS sequence (AUadapt) from InfluenzaA__ACZ17063__NA
augaaccccaaccagaagaucaucaccaucggcucggugugcaugaccaucgggauggccaaccugauccuccagaucggcaacaucaucuccaucuggaucagccacuccauccagcugggggaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20111 - RNA, 1410 nt, Artificial Sequence; identical to SEQ ID NO: 16318
  derived and/or modified CDS sequence (AUadapt) from InfluenzaA__ACZ17073__NA

SEQ ID NO: 20112 - RNA, 1410 nt, Artificial Sequence; identical to SEQ ID NO: 19848
  derived and/or modified CDS sequence (AUadapt) from InfluenzaA__ACZ17083__NA

SEQ ID NO: 20113 - RNA, 1410 nt, Artificial Sequence
  derived and/or modified CDS sequence (AUadapt) from InfluenzaA__ACZ17093__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcucccccuucgagugccgcaccuucuuccugacccagggcgcccugcucaacgacaagcacagcaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 20114 - RNA, 1410 nt, Artificial Sequence
  derived and/or modified CDS sequence (AUadapt) from InfluenzaA__ACZ17113__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20115 - RNA, 1410 nt, Artificial Sequence; identical to SEQ ID NO: 16318
  derived and/or modified CDS sequence (AUadapt) from InfluenzaA__ACZ17123__NA

SEQ ID NO: 20116 - RNA, 1410 nt, Artificial Sequence; identical to SEQ ID NO: 16318
  derived and/or modified CDS sequence (AUadapt) from InfluenzaA__ACZ17133__NA

SEQ ID NO: 20117 - RNA, 1410 nt, Artificial Sequence
  derived and/or modified CDS sequence (AUadapt) from InfluenzaA__ACZ17163__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccggaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 20118 - RNA, 1410 nt, Artificial Sequence; identical to SEQ ID NO: 20117
  derived and/or modified CDS sequence (AUadapt) from InfluenzaA__ACZ17173__NA

SEQ ID NO: 20119 - RNA, 1410 nt, Artificial Sequence; identical to SEQ ID NO: 20117
  derived and/or modified CDS sequence (AUadapt) from InfluenzaA__ACZ17183__NA

SEQ ID NO: 20120 - RNA, 1410 nt, Artificial Sequence; identical to SEQ ID NO: 20117
  derived and/or modified CDS sequence (AUadapt) from InfluenzaA__ACZ17193__NA

SEQ ID NO: 20121 - RNA, 1410 nt, Artificial Sequence; identical to SEQ ID NO: 20117
  derived and/or modified CDS sequence (AUadapt) from InfluenzaA__ACZ17203__NA

SEQ ID NO: 20122 - RNA, 1410 nt, Artificial Sequence; identical to SEQ ID NO: 16318
  derived and/or modified CDS sequence (AUadapt) from InfluenzaA__ACZ17213__NA

SEQ ID NO: 20123 - RNA, 1410 nt, Artificial Sequence; identical to SEQ ID NO: 16318
  derived and/or modified CDS sequence (AUadapt) from InfluenzaA__ACZ17223__NA

SEQ ID NO: 20124 - RNA, 1410 nt, Artificial Sequence; identical to SEQ ID NO: 16318
  derived and/or modified CDS sequence (AUadapt) from InfluenzaA__ACZ17233__NA

SEQ ID NO: 20125 - RNA, 1410 nt, Artificial Sequence; identical to SEQ ID NO: 16318
  derived and/or modified CDS sequence (AUadapt) from InfluenzaA__ACZ17243__NA

SEQ ID NO: 20126 - RNA, 1410 nt, Artificial Sequence; identical to SEQ ID NO: 16318
  derived and/or modified CDS sequence (AUadapt) from InfluenzaA__ACZ17263__NA

SEQ ID NO: 20127 - RNA, 1410 nt, Artificial Sequence
  derived and/or modified CDS sequence (AUadapt) from InfluenzaA__ACZ17273__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacggguucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucagcucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20128 - RNA, 1410 nt, Artificial Sequence; identical to SEQ ID NO: 16318
  derived and/or modified CDS sequence (AUadapt) from InfluenzaA__ACZ17283__NA

SEQ ID NO: 20129 - RNA, 1410 nt, Artificial Sequence; identical to SEQ ID NO: 19170
  derived and/or modified CDS sequence (AUadapt) from InfluenzaA__ACZ17293__NA

SEQ ID NO: 20130 - RNA, 1410 nt, Artificial Sequence; identical to SEQ ID NO: 19170
  derived and/or modified CDS sequence (AUadapt) from InfluenzaA__ACZ17303__NA

SEQ ID NO: 20131 - RNA, 1410 nt, Artificial Sequence; identical to SEQ ID NO: 19170
  derived and/or modified CDS sequence (AUadapt) from InfluenzaA__ACZ17313__NA

SEQ ID NO: 20132 - RNA, 1410 nt, Artificial Sequence; identical to SEQ ID NO: 16318
  derived and/or modified CDS sequence (AUadapt) from InfluenzaA__ACZ17401__NA

SEQ ID NO: 20133 - RNA, 1410 nt, Artificial Sequence; identical to SEQ ID NO: 16318
  derived and/or modified CDS sequence (AUadapt) from InfluenzaA__ACZ17411__NA

SEQ ID NO: 20134 - RNA, 1410 nt, Artificial Sequence; identical to SEQ ID NO: 16318
  derived and/or modified CDS sequence (AUadapt) from InfluenzaA__ACZ17421__NA

SEQ ID NO: 20135 - RNA, 1410 nt, Artificial Sequence
  derived and/or modified CDS sequence (AUadapt) from InfluenzaA__ACZ17431__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucaacagccggaacggcuucgagaugaucugggaccccaacggguggaccggcaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 20136 - RNA, 1410 nt, Artificial Sequence; identical to SEQ ID NO: 20135
  derived and/or modified CDS sequence (AUadapt) from InfluenzaA__ACZ17441__NA

SEQ ID NO: 20137 - RNA, 1410 nt, Artificial Sequence; identical to SEQ ID NO: 16274
  derived and/or modified CDS sequence (AUadapt) from InfluenzaA__ACZ17451__NA

SEQ ID NO: 20138 - RNA, 1410 nt, Artificial Sequence; identical to SEQ ID NO: 16318
  derived and/or modified CDS sequence (AUadapt) from InfluenzaA__ACZ17461__NA

SEQ ID NO: 20139 - RNA, 1410 nt, Artificial Sequence; identical to SEQ ID NO: 16318
  derived and/or modified CDS sequence (AUadapt) from InfluenzaA__ACZ17471__NA

SEQ ID NO: 20140 - RNA, 1410 nt, Artificial Sequence; identical to SEQ ID NO: 19170
  derived and/or modified CDS sequence (AUadapt) from InfluenzaA__ACZ17481__NA

SEQ ID NO: 20141 - RNA, 1410 nt, Artificial Sequence; identical to SEQ ID NO: 16318
  derived and/or modified CDS sequence (AUadapt) from InfluenzaA__ACZ17491__NA

SEQ ID NO: 20142 - RNA, 1410 nt, Artificial Sequence; identical to SEQ ID NO: 19606
  derived and/or modified CDS sequence (AUadapt) from InfluenzaA__ACZ27803__NA

SEQ ID NO: 20143 - RNA, 1410 nt, Artificial Sequence; identical to SEQ ID NO: 16274
  derived and/or modified CDS sequence (AUadapt) from InfluenzaA__ACZ27813__NA

SEQ ID NO: 20144 - RNA, 1410 nt, Artificial Sequence; identical to SEQ ID NO: 16318
  derived and/or modified CDS sequence (AUadapt) from InfluenzaA__ACZ27823__NA

SEQ ID NO: 20145 - RNA, 1410 nt, Artificial Sequence; identical to SEQ ID NO: 16274
  derived and/or modified CDS sequence (AUadapt) from InfluenzaA__ACZ27833__NA

SEQ ID NO: 20146 - RNA, 1410 nt, Artificial Sequence; identical to SEQ ID NO: 16318
  derived and/or modified CDS sequence (AUadapt) from InfluenzaA__ACZ45022__NA

SEQ ID NO: 20147 - RNA, 1410 nt, Artificial Sequence
  derived and/or modified CDS sequence (AUadapt) from InfluenzaA__ACZ53958__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggagcaagaagauccuccggacccaggaguccgagugcgucugcaucaacggcacgugcaccguggugaugaccgacggcucggccuccgggaaggcggacaccaagauccuguucaucgaggagggcaagaucguccacacgagcucgcuguccgggagcgcccagcacguggaggagugcuccugcuacccccgcuaccccggcgugcggugcgucugccgcgacaacuggaagggcucgaaccggccgaucguggacaucaacgugaaggacuacuccaucgucagcuccuacgugugcucggggcucgugggcgacacgccccgcaagaacgacuccagcuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggaccggggcaaccggagcggguacuccggcaucuucucggucgagggcaagagcugcaucaaccgcugcuucuacguggagcugauccgggggcgcaagcaggagaccgaggugcuguggaccuccaacucgaucgucguguucugcggcaccuccgggaccuacggcacggggagcugcccggacggcuccgugcucaaccugaugcccaucuga

SEQ ID NO: 20148 - RNA, 1410 nt, Artificial Sequence
  derived and/or modified CDS sequence (AUadapt) from InfluenzaA__ACZ53969__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgaagcaggucugcaucgccugguccucguccagcugccacgacggcaaggcguggcugcacgugugcgugaccggggacgacgagaacgccaccgccuccuucaucuacaacggccgccugguggacucgaucggguccuggucgaagaagauccuccggacccaggaguccgagugcgucugcaucaacggcacgugcaccguggugaugaccgacggcagcgccuccgggaaggcggacaccaagauccuguucaucgaggagggcgagaucguccacacgucgccccugagcggguccgcccagcacguggaggagugcucgugcuacccccgcuacccgggcgugcggugcgucugccgcgacaacuggaagggcuccaaccggcccaucguggacaucaacgugaaggacuacagcaucgucuccucguacgugugcuccgggcucgugggcgacacgccccgcaagaacgacagcuccucguccucgcacugccuggaccccaacaacgaggagggcgggcacggggucaagggcugggccuucgacgacggcaacgacguguggauggggcggaccaucuccgagaagucccgcagcggcuacgagaccuucaaggucaucgagggguggucgaagccgaacuccaagcugcagaucaaccgccaggugaucguggaccggggcaaccggagcggguacuccggcaucuucucggucgagggcaagagcugcaucaaccgcugcuucuacguggagcucauccgggggcgcaagcaggagaccgaggugcuguggaccuccaacucgaucgucguguucugcggcaccuccgggaccuacggcacggggagcuggcccgacggcuccgugcugaaccucaugcccaucuga

SEQ ID NO: 20149 - RNA, 1410 nt, Artificial Sequence
  derived and/or modified CDS sequence (AUadapt) from InfluenzaA__ACZ53980__NA
augaaccccaaccagaacaagcugccgaucggcucggugucccucaccaucgccaccaucugcuuccugaugcagaucgccauccugaagacgaccgucacccuccacuucaagcaguacgagugcaacucgccgcccaacaaccaggugaugcugugcgagcccaccaucaucgagcgcaaccugacgaagaucguguaccucaccaacaccaccaucaagaaggagaucugccccaagcagcccaaguaccggaacugguccaagcccaagugcaagaucacggagcuggcgcccuucucgaaggacaacuccauccgccugagcgccgggggcgacaucugggucacccgggagccguacguguccugcgaccccgacaagugcuaccaguucgcccucgggcagggcaccacccugaacaacgggcacucgaacgacacggugcacgaccgcacccccuaccggacccugcucaugaacgagcugggcguccccuuccaccugggcaccaagcaggucugcaucgccugguccucguccagcugccacgacgggaaggccuggcuccacgugugcaucacgggcgacgacaagaacgcgaccgccuccuucaucuacaacgggcgccugguggacucgaucguguccuggucgaaggagauccugcggacccaggaguccgagugcgugugcaucaacgggaccugcacggucgugaugaccgacgggagcgccuccggcaaggccgacaccaagauccucuucaucgaggagggcaagaucgugcacaucucgccgcugucgggguccgcgcagcacgucgaggagugcagcugcuacccccgcuaccccggcgugcggugcaucugccgcgacaacuggaagggguccaaccggcccguggucgacaucaacauggaggacuacucgaucgacuccucguacgugugcuccggccuggugggcgacaccccgcgcaagaacgacagcuccucguccucgcacugccucgaccccaacaacgaggagggcggccacggggucaagggcugggccuucgacgacgggaacgacguguggaugggccggacgaucuccgagaagcugcgcagcggcuacgagaccuucaaggugaucgggggcugguccaagcccaacucgaagcugcagaucaaccggcaggucaucguggaccgcgggaaccgguccggcuacucggggaucuucuccgucgagggcaagagcugcaucaaccgcugcuucuacguggagcucauccggggccgcaagcaggagaccgaggugcuguggaccucgaacuccaucgucguguucugcgggacgucgggcaccuacgggaccggcuccuggcccgacgggagcgugcugaaccucaugccgaucuga

SEQ ID NO: 20150 - RNA, 1410 nt, Artificial Sequence; identical to SEQ ID NO: 16318
  derived and/or modified CDS sequence (AUadapt) from InfluenzaA__ACZ56082__NA

SEQ ID NO: 20151 - RNA, 1410 nt, Artificial Sequence; identical to SEQ ID NO: 19723
  derived and/or modified CDS sequence (AUadapt) from InfluenzaA__ACZ57183__NA

SEQ ID NO: 20152 - RNA, 1413 nt, Artificial Sequence
  derived and/or modified CDS sequence (AUadapt) from InfluenzaA__ACZ81542__NA
augaaccccaaccagaaggugaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggucaaccacaccuacgugaacaucaacaacacgaacguggucgcgggggaggacaagaccagcgugacccuggccggcaacuccucgcugugcuccaucagcggcugggccaucuacaccaaggacaacuccauccggaucgggagcaagggcgacguguucgucauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggucaccaagagcaucgagcucaacgcccccaacuucuacuacgaggagugcuccugcuacccggacaccggcaucgugaugugcgugugccgggacaacuggcacgggucgaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccaacaccgacucggacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 20153 - RNA, 1413 nt, Artificial Sequence
  derived and/or modified CDS sequence (AUadapt) from InfluenzaA__ACZ81543__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacaacaccugggugaaccacaccuacgucaacaucaacaacacgaacgugguggcgggggaggacaagaccuccgucacccuggccggcaacucgucccugugcagcaucuccggcugggccaucuacaccaaggacaacagcauccggaucggguccaagggcgacguguucgugauccgcgagccguucaucucgugcucccaccucgagugccggacguucuuccugacccagggggcccugcucaacgacaagcacagcaacggcaccgucaaggaccgcucccccuaccgggcccugaugucgugcccccugggggaggcgcccuccccguacaacagcaaguucgagucgguggccugguccgccagcgccugccacgacggcaugggcuggcucaccaucgggaucuccggccccgacaacggggcgguggccguccugaaguacaacggcaucaucacgggcaccaucaagagcuggaaggagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcucgugcuacccggacaccggcaucgucaugugcgugugccgggacaacuggcacggguccaaccgccccugggugagcuucaaccagaaccuggacuaccagaccggcuacaucugcuccggcgucuucggggacaacccccggcccgaggacggcgaggggucgugcaacccggugacgguggacggcgcgaacggggucaagggcuucuccuacaaguacggcaacgggguguggaucggccgcaccaagagcaaccggcugcgcaagggguucgagaugaucugggaccccaacggcuggaccaacaccgacuccgacuucagcgugaagcaggacgucguggccaucacggacugguccggguacucgggcagcuucgugcagcaccccgagcucaccggccuggacugcauccggcccugcuucugggucgagcuggugcgcgggcucccgcgggagaacaccaccaucuggacguccggcucguccaucagcuucugcggggucaacuccgacaccgccaacuggagcuggcccgacggcgccgagcugcccuucaccaucgacaaguga

SEQ ID NO: 20154 - RNA, 1410 nt, Artificial Sequence
  derived and/or modified CDS sequence (AUadapt) from InfluenzaA__ACZ81546__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguccgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccacgaccgcaccccguaccggacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcgccugguggacagcguggucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggaccacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagucccgccugggcuacgagaccuucaaggucaucgagggguggucgaaccccaagagcaagcugcagaucaaccgccaggugaucguggaccggggcaaccgguccggguacucgggcaucuucagcgucgaggggaaguccugcaucaaccgcugcuucuacguggagcucauccggggccgcaaggaggagaccgaggugcuguggaccucgaacuccaucgucguguucugcggcaccagcgggacguacggcaccggguccuggccggacggcgccgacaucaaccugaugcccaucuga

SEQ ID NO: 20155 - RNA, 1410 nt, Artificial Sequence
  derived and/or modified CDS sequence (AUadapt) from InfluenzaA__ACZ81547__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaccaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggacaagggcaaccggagcggguacuccggcaucuucucggucgagggcaagagcugcaucaaccgcugcuucuacguggagcucauccgggggcgcaaggaggagaccgaggugcuguggaccuccaacucgaucgucguguucugcggcacguccgggaccuacggcaccgggagcuggccggacggcgccgacaucaaccugaugcccaucuga

SEQ ID NO: 20156 - RNA, 1410 nt, Artificial Sequence; identical to SEQ ID NO: 16318
  derived and/or modified CDS sequence (AUadapt) from InfluenzaA__ACZ81634__NA

SEQ ID NO: 20157 - RNA, 1410 nt, Artificial Sequence
  derived and/or modified CDS sequence (AUadapt) from InfluenzaA__ACZ81644__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20158 - RNA, 1410 nt, Artificial Sequence
  derived and/or modified CDS sequence (AUadapt) from InfluenzaA__ACZ81653__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20159 - RNA, 1410 nt, Artificial Sequence; identical to SEQ ID NO: 16318
  derived and/or modified CDS sequence (AUadapt) from InfluenzaA__ACZ95840__NA

SEQ ID NO: 20160 - RNA, 1410 nt, Artificial Sequence; identical to SEQ ID NO: 16318
  derived and/or modified CDS sequence (AUadapt) from InfluenzaA__ACZ95850__NA

SEQ ID NO: 20161 - RNA, 1410 nt, Artificial Sequence; identical to SEQ ID NO: 16318
  derived and/or modified CDS sequence (AUadapt) from InfluenzaA__ACZ95860__NA

SEQ ID NO: 20162 - RNA, 1410 nt, Artificial Sequence; identical to SEQ ID NO: 16318
  derived and/or modified CDS sequence (AUadapt) from InfluenzaA__ACZ95870__NA

SEQ ID NO: 20163 - RNA, 1410 nt, Artificial Sequence; identical to SEQ ID NO: 16318
  derived and/or modified CDS sequence (AUadapt) from InfluenzaA__ACZ95880__NA

SEQ ID NO: 20164 - RNA, 1410 nt, Artificial Sequence; identical to SEQ ID NO: 16318
  derived and/or modified CDS sequence (AUadapt) from InfluenzaA__ACZ95890__NA

SEQ ID NO: 20165 - RNA, 1410 nt, Artificial Sequence; identical to SEQ ID NO: 16318
  derived and/or modified CDS sequence (AUadapt) from InfluenzaA__ACZ95900__NA

SEQ ID NO: 20166 - RNA, 1410 nt, Artificial Sequence; identical to SEQ ID NO: 16318
  derived and/or modified CDS sequence (AUadapt) from InfluenzaA__ACZ95910__NA

SEQ ID NO: 20167 - RNA, 1410 nt, Artificial Sequence; identical to SEQ ID NO: 16318
  derived and/or modified CDS sequence (AUadapt) from InfluenzaA__ACZ95920__NA

SEQ ID NO: 20168 - RNA, 1410 nt, Artificial Sequence; identical to SEQ ID NO: 20027
  derived and/or modified CDS sequence (AUadapt) from InfluenzaA__ACZ95930__NA

SEQ ID NO: 20169 - RNA, 1410 nt, Artificial Sequence; identical to SEQ ID NO: 16318
  derived and/or modified CDS sequence (AUadapt) from InfluenzaA__ACZ95940__NA

SEQ ID NO: 20170 - RNA, 1410 nt, Artificial Sequence; identical to SEQ ID NO: 20157
  derived and/or modified CDS sequence (AUadapt) from InfluenzaA__ACZ95950__NA

SEQ ID NO: 20171 - RNA, 1410 nt, Artificial Sequence; identical to SEQ ID NO: 16318
  derived and/or modified CDS sequence (AUadapt) from InfluenzaA__ACZ95960__NA

SEQ ID NO: 20172 - RNA, 1410 nt, Artificial Sequence; identical to SEQ ID NO: 20157
  derived and/or modified CDS sequence (AUadapt) from InfluenzaA__ACZ95970__NA

SEQ ID NO: 20173 - RNA, 1410 nt, Artificial Sequence; identical to SEQ ID NO: 16318
  derived and/or modified CDS sequence (AUadapt) from InfluenzaA__ACZ95980__NA

SEQ ID NO: 20174 - RNA, 1410 nt, Artificial Sequence; identical to SEQ ID NO: 16318
  derived and/or modified CDS sequence (AUadapt) from InfluenzaA__ACZ95990__NA

SEQ ID NO: 20175 - RNA, 1410 nt, Artificial Sequence; identical to SEQ ID NO: 16318
  derived and/or modified CDS sequence (AUadapt) from InfluenzaA__ACZ96000__NA

SEQ ID NO: 20176 - RNA, 1410 nt, Artificial Sequence; identical to SEQ ID NO: 16318
  derived and/or modified CDS sequence (AUadapt) from InfluenzaA__ACZ96010__NA

SEQ ID NO: 20177 - RNA, 1410 nt, Artificial Sequence
  derived and/or modified CDS sequence (AUadapt) from InfluenzaA__ACZ96020__NA
augaaccccaaccagaagaucaucaccaucggcucggugugcaugaccaucgggauggccaaccugauccuccagaucggcaacaucauccugaucuggaucucccacagcauccagcuggggaaccagaaccagacggagaccugcaaccaguccgucaucaccuacgagaacaacaccugggugaaccagacguacgugaacaucagcaacaccaacuucgccgcgggccaguccgucgugagcgugaagcucgccgggaacuccucgcugugcccggucuccggcugggccaucuacagcaaggacaacuccgugcgcaucggcagcaagggggacguguucgucauccgggagcccuucaucuccugcagcccccuggagugccgcaccuucuuccucacccagggcgcccugcugaacgacaagcacuccaacgggacgaucaaggaccggagccccuaccgcacccucauguccugcccgaucggcgaggugcccucgcccuacaacucccgguucgagagcguggccuggagcgcguccgccugccacgacgggaucaacuggcugaccaucggcaucagcggccccgacaacggggccgucgccgugcugaaguacaacggcaucaucaccgacacgaucaaguccuggcgcaacaacauccuccggacccaggagagcgagugcgcgugcgugaacggguccugcuucaccgucaugaccgacggcccgucgaacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccagaucggguacaucugcucgggcaucuucggggacaacccgcggcccaucgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcacggacaacaacuucuccaucaagcaggacaucguggggaucaacgaguggucgggcuacuccgggagcuucguccagcacccggagcugaccggccucgacugcauccgccccugcuucuggguggagcugauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 20178 - RNA, 1410 nt, Artificial Sequence; identical to SEQ ID NO: 16318
  derived and/or modified CDS sequence (AUadapt) from InfluenzaA__ACZ96050__NA

SEQ ID NO: 20179 - RNA, 1410 nt, Artificial Sequence; identical to SEQ ID NO: 16318
  derived and/or modified CDS sequence (AUadapt) from InfluenzaA__ACZ96060__NA

SEQ ID NO: 20180 - RNA, 1410 nt, Artificial Sequence; identical to SEQ ID NO: 16318
  derived and/or modified CDS sequence (AUadapt) from InfluenzaA__ACZ96072__NA

SEQ ID NO: 20181 - RNA, 1410 nt, Artificial Sequence; identical to SEQ ID NO: 16318
  derived and/or modified CDS sequence (AUadapt) from InfluenzaA__ACZ96082__NA

SEQ ID NO: 20182 - RNA, 1410 nt, Artificial Sequence; identical to SEQ ID NO: 16318
  derived and/or modified CDS sequence (AUadapt) from InfluenzaA__ACZ96092__NA

SEQ ID NO: 20183 - RNA, 1410 nt, Artificial Sequence; identical to SEQ ID NO: 16318
  derived and/or modified CDS sequence (AUadapt) from InfluenzaA__ACZ96102__NA

SEQ ID NO: 20184 - RNA, 1410 nt, Artificial Sequence; identical to SEQ ID NO: 16318
  derived and/or modified CDS sequence (AUadapt) from InfluenzaA__ACZ96112__NA

SEQ ID NO: 20185 - RNA, 1410 nt, Artificial Sequence
  derived and/or modified CDS sequence (AUadapt) from InfluenzaA__ACZ96122__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgaggccugcaaccagagcgucaucacguacgagaacaacaccugggugaaccagaccuacgugaacaucuccaacaccaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaaggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggacgagcggguccagcaucuccuucugcggcaucaacagcgacaccguggggugguccuggcccgacggcgcggagcugccguucaccaucgacaaguga

SEQ ID NO: 20186 - RNA, 1410 nt, Artificial Sequence; identical to SEQ ID NO: 16318
  derived and/or modified CDS sequence (AUadapt) from InfluenzaA__ACZ96132__NA

SEQ ID NO: 20187 - RNA, 1410 nt, Artificial Sequence; identical to SEQ ID NO: 16318
  derived and/or modified CDS sequence (AUadapt) from InfluenzaA__ACZ96142__NA

SEQ ID NO: 20188 - RNA, 1410 nt, Artificial Sequence; identical to SEQ ID NO: 16318
  derived and/or modified CDS sequence (AUadapt) from InfluenzaA__ACZ96152__NA

SEQ ID NO: 20189 - RNA, 1410 nt, Artificial Sequence; identical to SEQ ID NO: 16318
  derived and/or modified CDS sequence (AUadapt) from InfluenzaA__ACZ96162__NA

SEQ ID NO: 20190 - RNA, 1410 nt, Artificial Sequence; identical to SEQ ID NO: 16318
  derived and/or modified CDS sequence (AUadapt) from InfluenzaA__ACZ96172__NA

SEQ ID NO: 20191 - RNA, 1410 nt, Artificial Sequence
  derived and/or modified CDS sequence (AUadapt) from InfluenzaA__ACZ96182__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgaccggcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 20192 - RNA, 1410 nt, Artificial Sequence
  derived and/or modified CDS sequence (AUadapt) from InfluenzaA__ACZ96192__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggucgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 20193 - RNA, 1410 nt, Artificial Sequence
  derived and/or modified CDS sequence (AUadapt) from InfluenzaA__ACZ96232__NA
augaaccccaaccagaagaucaucaccaucggcucggugugcaugaccgucgggauggccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacgacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20194 - RNA, 1410 nt, Artificial Sequence
  derived and/or modified CDS sequence (AUadapt) from InfluenzaA__ACZ96242__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagagcaccaucuggaccuccgggagcuccaucagcuucugcggcgugaacuccgacaccgucggguggagcuggcccgacggcgccgagcugccguucacgaucgacaaguga

SEQ ID NO: 20195 - RNA, 1410 nt, Artificial Sequence; identical to SEQ ID NO: 16318
  derived and/or modified CDS sequence (AUadapt) from InfluenzaA__ACZ96252__NA

SEQ ID NO: 20196 - RNA, 1410 nt, Artificial Sequence; identical to SEQ ID NO: 16318
  derived and/or modified CDS sequence (AUadapt) from InfluenzaA__ACZ96292__NA

SEQ ID NO: 20197 - RNA, 1410 nt, Artificial Sequence; identical to SEQ ID NO: 16318
  derived and/or modified CDS sequence (AUadapt) from InfluenzaA__ACZ96302__NA

SEQ ID NO: 20198 - RNA, 1410 nt, Artificial Sequence; identical to SEQ ID NO: 16318
  derived and/or modified CDS sequence (AUadapt) from InfluenzaA__ACZ96312__NA

SEQ ID NO: 20199 - RNA, 1410 nt, Artificial Sequence
  derived and/or modified CDS sequence (AUadapt) from InfluenzaA__ACZ96322__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugaccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 20200 - RNA, 1410 nt, Artificial Sequence; identical to SEQ ID NO: 20199
  derived and/or modified CDS sequence (AUadapt) from InfluenzaA__ACZ96332__NA

SEQ ID NO: 20201 - RNA, 1410 nt, Artificial Sequence; identical to SEQ ID NO: 16318
  derived and/or modified CDS sequence (AUadapt) from InfluenzaA__ACZ96352__NA

SEQ ID NO: 20202 - RNA, 1410 nt, Artificial Sequence; identical to SEQ ID NO: 20199
  derived and/or modified CDS sequence (AUadapt) from InfluenzaA__ACZ96362__NA

SEQ ID NO: 20203 - RNA, 1410 nt, Artificial Sequence; identical to SEQ ID NO: 16318
  derived and/or modified CDS sequence (AUadapt) from InfluenzaA__ACZ96375__NA

SEQ ID NO: 20204 - RNA, 1410 nt, Artificial Sequence; identical to SEQ ID NO: 20199
  derived and/or modified CDS sequence (AUadapt) from InfluenzaA__ACZ96385__NA

SEQ ID NO: 20205 - RNA, 1410 nt, Artificial Sequence
  derived and/or modified CDS sequence (AUadapt) from InfluenzaA__ACZ96395__NA
augaaccccaaccagaagaucaucaccaucggcucggugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaucgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 20206 - RNA, 1410 nt, Artificial Sequence; identical to SEQ ID NO: 16318
  derived and/or modified CDS sequence (AUadapt) from InfluenzaA__ACZ96408__NA

SEQ ID NO: 20207 - RNA, 1410 nt, Artificial Sequence; identical to SEQ ID NO: 16318
  derived and/or modified CDS sequence (AUadapt) from InfluenzaA__ACZ96428__NA

SEQ ID NO: 20208 - RNA, 1410 nt, Artificial Sequence; identical to SEQ ID NO: 16318
  derived and/or modified CDS sequence (AUadapt) from InfluenzaA__ACZ96438__NA

SEQ ID NO: 20209 - RNA, 1410 nt, Artificial Sequence; identical to SEQ ID NO: 16318
  derived and/or modified CDS sequence (AUadapt) from InfluenzaA__ACZ96448__NA

SEQ ID NO: 20210 - RNA, 1410 nt, Artificial Sequence; identical to SEQ ID NO: 16318
  derived and/or modified CDS sequence (AUadapt) from InfluenzaA__ACZ96479__NA

SEQ ID NO: 20211 - RNA, 1410 nt, Artificial Sequence; identical to SEQ ID NO: 20157
  derived and/or modified CDS sequence (AUadapt) from InfluenzaA__ACZ96489__NA

SEQ ID NO: 20212 - RNA, 1410 nt, Artificial Sequence; identical to SEQ ID NO: 16318
  derived and/or modified CDS sequence (AUadapt) from InfluenzaA__ACZ96499__NA

SEQ ID NO: 20213 - RNA, 1410 nt, Artificial Sequence
  derived and/or modified CDS sequence (AUadapt) from InfluenzaA__ACZ96509__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccuggaucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20214 - RNA, 1410 nt, Artificial Sequence; identical to SEQ ID NO: 16318
  derived and/or modified CDS sequence (AUadapt) from InfluenzaA__ACZ96519__NA

SEQ ID NO: 20215 - RNA, 1410 nt, Artificial Sequence; identical to SEQ ID NO: 16318
  derived and/or modified CDS sequence (AUadapt) from InfluenzaA__ACZ96529__NA

SEQ ID NO: 20216 - RNA, 1410 nt, Artificial Sequence
  derived and/or modified CDS sequence (AUadapt) from InfluenzaA__ACZ96552__NA
augaaccccaaccagaagaucaucaccaucggcucggugugcaugaccaucgggauggccaaccugauccuccagaucggcaacaucaucuccaucuggaucagccacuccagccagcuggggaaccagaaccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20217 - RNA, 1410 nt, Artificial Sequence; identical to SEQ ID NO: 16318
  derived and/or modified CDS sequence (AUadapt) from InfluenzaA__ACZ96562__NA

SEQ ID NO: 20218 - RNA, 1410 nt, Artificial Sequence; identical to SEQ ID NO: 16318
  derived and/or modified CDS sequence (AUadapt) from InfluenzaA__ACZ96572__NA

SEQ ID NO: 20219 - RNA, 1410 nt, Artificial Sequence; identical to SEQ ID NO: 16318
  derived and/or modified CDS sequence (AUadapt) from InfluenzaA__ACZ96582__NA

SEQ ID NO: 20220 - RNA, 1410 nt, Artificial Sequence
  derived and/or modified CDS sequence (AUadapt) from InfluenzaA__ACZ96592__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccagagcuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 20221 - RNA, 1410 nt, Artificial Sequence; identical to SEQ ID NO: 16318
  derived and/or modified CDS sequence (AUadapt) from InfluenzaA__ACZ96602__NA

SEQ ID NO: 20222 - RNA, 1410 nt, Artificial Sequence
  derived and/or modified CDS sequence (AUadapt) from InfluenzaA__ACZ96612__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucgugaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 20223 - RNA, 1410 nt, Artificial Sequence; identical to SEQ ID NO: 19170
  derived and/or modified CDS sequence (AUadapt) from InfluenzaA__ACZ96622__NA

SEQ ID NO: 20224 - RNA, 1410 nt, Artificial Sequence; identical to SEQ ID NO: 19170
  derived and/or modified CDS sequence (AUadapt) from InfluenzaA__ACZ96632__NA

SEQ ID NO: 20225 - RNA, 1410 nt, Artificial Sequence; identical to SEQ ID NO: 19170
  derived and/or modified CDS sequence (AUadapt) from InfluenzaA__ACZ96642__NA

SEQ ID NO: 20226 - RNA, 1410 nt, Artificial Sequence; identical to SEQ ID NO: 19170
  derived and/or modified CDS sequence (AUadapt) from InfluenzaA__ACZ96652__NA

SEQ ID NO: 20227 - RNA, 1410 nt, Artificial Sequence; identical to SEQ ID NO: 19170
  derived and/or modified CDS sequence (AUadapt) from InfluenzaA__ACZ96662__NA

SEQ ID NO: 20228 - RNA, 1410 nt, Artificial Sequence; identical to SEQ ID NO: 19170
  derived and/or modified CDS sequence (AUadapt) from InfluenzaA__ACZ96672__NA

SEQ ID NO: 20229 - RNA, 1410 nt, Artificial Sequence; identical to SEQ ID NO: 19170
  derived and/or modified CDS sequence (AUadapt) from InfluenzaA__ACZ96682__NA

SEQ ID NO: 20230 - RNA, 1410 nt, Artificial Sequence; identical to SEQ ID NO: 19170
  derived and/or modified CDS sequence (AUadapt) from InfluenzaA__ACZ96692__NA

SEQ ID NO: 20231 - RNA, 1410 nt, Artificial Sequence; identical to SEQ ID NO: 19170
  derived and/or modified CDS sequence (AUadapt) from InfluenzaA__ACZ96702__NA

SEQ ID NO: 20232 - RNA, 1410 nt, Artificial Sequence; identical to SEQ ID NO: 19170
  derived and/or modified CDS sequence (AUadapt) from InfluenzaA__ACZ96712__NA

SEQ ID NO: 20233 - RNA, 1410 nt, Artificial Sequence; identical to SEQ ID NO: 19170
  derived and/or modified CDS sequence (AUadapt) from InfluenzaA__ACZ96722__NA

SEQ ID NO: 20234 - RNA, 1410 nt, Artificial Sequence; identical to SEQ ID NO: 19170
  derived and/or modified CDS sequence (AUadapt) from InfluenzaA__ACZ96732__NA

SEQ ID NO: 20235 - RNA, 1410 nt, Artificial Sequence; identical to SEQ ID NO: 19170
  derived and/or modified CDS sequence (AUadapt) from InfluenzaA__ACZ96742__NA

SEQ ID NO: 20236 - RNA, 1410 nt, Artificial Sequence; identical to SEQ ID NO: 16274
  derived and/or modified CDS sequence (AUadapt) from InfluenzaA__ACZ96752__NA

SEQ ID NO: 20237 - RNA, 1410 nt, Artificial Sequence; identical to SEQ ID NO: 16274
  derived and/or modified CDS sequence (AUadapt) from InfluenzaA__ACZ96762__NA

SEQ ID NO: 20238 - RNA, 1410 nt, Artificial Sequence; identical to SEQ ID NO: 16274
  derived and/or modified CDS sequence (AUadapt) from InfluenzaA__ACZ96772__NA

SEQ ID NO: 20239 - RNA, 1410 nt, Artificial Sequence; identical to SEQ ID NO: 16274
  derived and/or modified CDS sequence (AUadapt) from InfluenzaA__ACZ96782__NA

SEQ ID NO: 20240 - RNA, 1410 nt, Artificial Sequence; identical to SEQ ID NO: 16274
  derived and/or modified CDS sequence (AUadapt) from InfluenzaA__ACZ96792__NA

SEQ ID NO: 20241 - RNA, 1410 nt, Artificial Sequence; identical to SEQ ID NO: 16318
  derived and/or modified CDS sequence (AUadapt) from InfluenzaA__ACZ96802__NA

SEQ ID NO: 20242 - RNA, 1410 nt, Artificial Sequence; identical to SEQ ID NO: 16318
  derived and/or modified CDS sequence (AUadapt) from InfluenzaA__ACZ96812__NA

SEQ ID NO: 20243 - RNA, 1410 nt, Artificial Sequence; identical to SEQ ID NO: 19723
  derived and/or modified CDS sequence (AUadapt) from InfluenzaA__ACZ96822__NA

SEQ ID NO: 20244 - RNA, 1410 nt, Artificial Sequence
  derived and/or modified CDS sequence (AUadapt) from InfluenzaA__ACZ96842__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaucgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20245 - RNA, 1410 nt, Artificial Sequence; identical to SEQ ID NO: 16318
  derived and/or modified CDS sequence (AUadapt) from InfluenzaA__ACZ96852__NA

SEQ ID NO: 20246 - RNA, 1410 nt, Artificial Sequence; identical to SEQ ID NO: 16318
  derived and/or modified CDS sequence (AUadapt) from InfluenzaA__ACZ96862__NA

SEQ ID NO: 20247 - RNA, 1410 nt, Artificial Sequence
  derived and/or modified CDS sequence (AUadapt) from InfluenzaA__ACZ96872__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20248 - RNA, 1410 nt, Artificial Sequence; identical to SEQ ID NO: 16274
  derived and/or modified CDS sequence (AUadapt) from InfluenzaA__ACZ96882__NA

SEQ ID NO: 20249 - RNA, 1410 nt, Artificial Sequence; identical to SEQ ID NO: 20247
  derived and/or modified CDS sequence (AUadapt) from InfluenzaA__ACZ96892__NA

SEQ ID NO: 20250 - RNA, 1410 nt, Artificial Sequence; identical to SEQ ID NO: 20247
  derived and/or modified CDS sequence (AUadapt) from InfluenzaA__ACZ96902__NA

SEQ ID NO: 20251 - RNA, 1410 nt, Artificial Sequence; identical to SEQ ID NO: 16274
  derived and/or modified CDS sequence (AUadapt) from InfluenzaA__ACZ96912__NA

SEQ ID NO: 20252 - RNA, 1410 nt, Artificial Sequence; identical to SEQ ID NO: 16274
  derived and/or modified CDS sequence (AUadapt) from InfluenzaA__ACZ96922__NA

SEQ ID NO: 20253 - RNA, 1410 nt, Artificial Sequence; identical to SEQ ID NO: 20247
  derived and/or modified CDS sequence (AUadapt) from InfluenzaA__ACZ96932__NA

SEQ ID NO: 20254 - RNA, 1410 nt, Artificial Sequence; identical to SEQ ID NO: 20247
  derived and/or modified CDS sequence (AUadapt) from InfluenzaA__ACZ96942__NA

SEQ ID NO: 20255 - RNA, 1410 nt, Artificial Sequence; identical to SEQ ID NO: 16274
  derived and/or modified CDS sequence (AUadapt) from InfluenzaA__ACZ96952__NA

SEQ ID NO: 20256 - RNA, 1410 nt, Artificial Sequence; identical to SEQ ID NO: 16274
  derived and/or modified CDS sequence (AUadapt) from InfluenzaA__ACZ97024__NA

SEQ ID NO: 20257 - RNA, 1410 nt, Artificial Sequence; identical to SEQ ID NO: 20247
  derived and/or modified CDS sequence (AUadapt) from InfluenzaA__ACZ97336__NA

SEQ ID NO: 20258 - RNA, 1410 nt, Artificial Sequence; identical to SEQ ID NO: 20247
  derived and/or modified CDS sequence (AUadapt) from InfluenzaA__ACZ97346__NA

SEQ ID NO: 20259 - RNA, 1410 nt, Artificial Sequence; identical to SEQ ID NO: 16318
  derived and/or modified CDS sequence (AUadapt) from InfluenzaA__ACZ97366__NA

SEQ ID NO: 20260 - RNA, 1410 nt, Artificial Sequence; identical to SEQ ID NO: 16318
  derived and/or modified CDS sequence (AUadapt) from InfluenzaA__ACZ97376__NA

SEQ ID NO: 20261 - RNA, 1410 nt, Artificial Sequence; identical to SEQ ID NO: 16318
  derived and/or modified CDS sequence (AUadapt) from InfluenzaA__ACZ97386__NA

SEQ ID NO: 20262 - RNA, 1410 nt, Artificial Sequence; identical to SEQ ID NO: 20247
  derived and/or modified CDS sequence (AUadapt) from InfluenzaA__ACZ97396__NA

SEQ ID NO: 20263 - RNA, 1410 nt, Artificial Sequence; identical to SEQ ID NO: 16318
  derived and/or modified CDS sequence (AUadapt) from InfluenzaA__ACZ98171__NA

SEQ ID NO: 20264 - RNA, 1410 nt, Artificial Sequence; identical to SEQ ID NO: 16318
  derived and/or modified CDS sequence (AUadapt) from InfluenzaA__ACZ98181__NA

SEQ ID NO: 20265 - RNA, 1410 nt, Artificial Sequence
  derived and/or modified CDS sequence (AUadapt) from InfluenzaA__ACZ98191__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucuccuacgagaacaacaccugggugaaccagaccuacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggucgcccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagucggagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 20266 - RNA, 1410 nt, Artificial Sequence; identical to SEQ ID NO: 16274
  derived and/or modified CDS sequence (AUadapt) from InfluenzaA__ACZ98201__NA

SEQ ID NO: 20267 - RNA, 1410 nt, Artificial Sequence; identical to SEQ ID NO: 16318
  derived and/or modified CDS sequence (AUadapt) from InfluenzaA__ACZ98211__NA

SEQ ID NO: 20268 - RNA, 1410 nt, Artificial Sequence; identical to SEQ ID NO: 16318
  derived and/or modified CDS sequence (AUadapt) from InfluenzaA__ACZ98221__NA

SEQ ID NO: 20269 - RNA, 1410 nt, Artificial Sequence; identical to SEQ ID NO: 16318
  derived and/or modified CDS sequence (AUadapt) from InfluenzaA__ACZ98231__NA

SEQ ID NO: 20270 - RNA, 1410 nt, Artificial Sequence; identical to SEQ ID NO: 16318
  derived and/or modified CDS sequence (AUadapt) from InfluenzaA__ACZ98241__NA

SEQ ID NO: 20271 - RNA, 1410 nt, Artificial Sequence; identical to SEQ ID NO: 20117
  derived and/or modified CDS sequence (AUadapt) from InfluenzaA__ACZ98251__NA

SEQ ID NO: 20272 - RNA, 1410 nt, Artificial Sequence; identical to SEQ ID NO: 16318
  derived and/or modified CDS sequence (AUadapt) from InfluenzaA__ACZ98261__NA

SEQ ID NO: 20273 - RNA, 1410 nt, Artificial Sequence; identical to SEQ ID NO: 16318
  derived and/or modified CDS sequence (AUadapt) from InfluenzaA__ACZ98271__NA

SEQ ID NO: 20274 - RNA, 1410 nt, Artificial Sequence; identical to SEQ ID NO: 16318
  derived and/or modified CDS sequence (AUadapt) from InfluenzaA__ACZ98281__NA

SEQ ID NO: 20275 - RNA, 1410 nt, Artificial Sequence; identical to SEQ ID NO: 16318
  derived and/or modified CDS sequence (AUadapt) from InfluenzaA__ACZ98291__NA

SEQ ID NO: 20276 - RNA, 1410 nt, Artificial Sequence; identical to SEQ ID NO: 16274
  derived and/or modified CDS sequence (AUadapt) from InfluenzaA__ACZ98301__NA

SEQ ID NO: 20277 - RNA, 1410 nt, Artificial Sequence
  derived and/or modified CDS sequence (AUadapt) from InfluenzaA__ACZ98321__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucaacagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20278 - RNA, 1410 nt, Artificial Sequence; identical to SEQ ID NO: 16318
  derived and/or modified CDS sequence (AUadapt) from InfluenzaA__ACZ98331__NA

SEQ ID NO: 20279 - RNA, 1410 nt, Artificial Sequence
  derived and/or modified CDS sequence (AUadapt) from InfluenzaA__ACZ98341__NA
augaaccccaaccagaagaucaucaccaucggcucggugugcaucaccaucgggauggccaaccugauccuccagaucggcaacaucaucuccaucuggaucagccacccgauccagcuggggaaccagaaccagaucgagacgugcaaccaguccgucaucaccuacgagaacaacaccugggugaaccagaccuacgugaacaucagcaacacgaaccuggccgcgggccaguccgucgugucggugaagcucgccgggaacuccagccugugccccgucuccggcugggccaucuacagcaaggacaacuccauccgcaucggcagcaagggggacguguucgugauccgggagcccuucaucuccugcucgccccuggagugccgcaccuucuuccucacccagggcgcccugcugaacgacaagcacuccaacgggaccaucaaggaccggagcccguaccgcacgcucauguccugccccaucggcgagguccccagccccuacaacucccgguucgagucgguggccuggagcgcguccgccugccacgacgggaucaacuggcugaccaucggcaucagcggcccggacaacggggccguggccguccugaaguacaacggcaucaucaccgacaccaucaaguccuggcgcaacaacauccuccggacgcaggagagcgagugcgcgugcgugaacggguccugcuucaccgugaugaccgacggccccucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgcccgugggucuccuucaaccagaaccuggaguaccagaucggguacaucugcagcggcaucuucggggacaacccccggcccaacgacaagaccggcuccugcggccccgugagcuccaacggggccaacggcgugaagggguucagcuucaaguacggcaacggggucuggaucggccgcaccaaguccaucucgagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccucgacugcauccgccccugcuucugggucgagcugauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 20280 - RNA, 1410 nt, Artificial Sequence; identical to SEQ ID NO: 16318
  derived and/or modified CDS sequence (AUadapt) from InfluenzaA__ACZ98351__NA

SEQ ID NO: 20281 - RNA, 1410 nt, Artificial Sequence; identical to SEQ ID NO: 16318
  derived and/or modified CDS sequence (AUadapt) from InfluenzaA__ACZ98361__NA

SEQ ID NO: 20282 - RNA, 1410 nt, Artificial Sequence; identical to SEQ ID NO: 16318
  derived and/or modified CDS sequence (AUadapt) from InfluenzaA__ACZ98371__NA

SEQ ID NO: 20283 - RNA, 1410 nt, Artificial Sequence; identical to SEQ ID NO: 16318
  derived and/or modified CDS sequence (AUadapt) from InfluenzaA__ACZ98381__NA

SEQ ID NO: 20284 - RNA, 1410 nt, Artificial Sequence; identical to SEQ ID NO: 16318
  derived and/or modified CDS sequence (AUadapt) from InfluenzaA__ACZ98391__NA

SEQ ID NO: 20285 - RNA, 1410 nt, Artificial Sequence; identical to SEQ ID NO: 16318
  derived and/or modified CDS sequence (AUadapt) from InfluenzaA__ACZ98401__NA

SEQ ID NO: 20286 - RNA, 1410 nt, Artificial Sequence; identical to SEQ ID NO: 16318
  derived and/or modified CDS sequence (AUadapt) from InfluenzaA__ACZ98411__NA

SEQ ID NO: 20287 - RNA, 1410 nt, Artificial Sequence; identical to SEQ ID NO: 19170
  derived and/or modified CDS sequence (AUadapt) from InfluenzaA__ACZ98421__NA

SEQ ID NO: 20288 - RNA, 1410 nt, Artificial Sequence; identical to SEQ ID NO: 16318
  derived and/or modified CDS sequence (AUadapt) from InfluenzaA__ACZ98431__NA

SEQ ID NO: 20289 - RNA, 1410 nt, Artificial Sequence; identical to SEQ ID NO: 16318
  derived and/or modified CDS sequence (AUadapt) from InfluenzaA__ACZ98441__NA

SEQ ID NO: 20290 - RNA, 1410 nt, Artificial Sequence; identical to SEQ ID NO: 16318
  derived and/or modified CDS sequence (AUadapt) from InfluenzaA__ACZ98451__NA

SEQ ID NO: 20291 - RNA, 1410 nt, Artificial Sequence; identical to SEQ ID NO: 16318
  derived and/or modified CDS sequence (AUadapt) from InfluenzaA__ACZ98461__NA

SEQ ID NO: 20292 - RNA, 1410 nt, Artificial Sequence; identical to SEQ ID NO: 19723
  derived and/or modified CDS sequence (AUadapt) from InfluenzaA__ACZ98674__NA

SEQ ID NO: 20293 - RNA, 1410 nt, Artificial Sequence; identical to SEQ ID NO: 20247
  derived and/or modified CDS sequence (AUadapt) from InfluenzaA__ACZ98684__NA

SEQ ID NO: 20294 - RNA, 1410 nt, Artificial Sequence; identical to SEQ ID NO: 20193
  derived and/or modified CDS sequence (AUadapt) from InfluenzaA__ACZ98694__NA

SEQ ID NO: 20295 - RNA, 1410 nt, Artificial Sequence; identical to SEQ ID NO: 16318
  derived and/or modified CDS sequence (AUadapt) from InfluenzaA__ADA60801__NA

SEQ ID NO: 20296 - RNA, 1410 nt, Artificial Sequence; identical to SEQ ID NO: 16318
  derived and/or modified CDS sequence (AUadapt) from InfluenzaA__ADA69294__NA

SEQ ID NO: 20297 - RNA, 1410 nt, Artificial Sequence; identical to SEQ ID NO: 16318
  derived and/or modified CDS sequence (AUadapt) from InfluenzaA__ADA69304__NA

SEQ ID NO: 20298 - RNA, 1410 nt, Artificial Sequence; identical to SEQ ID NO: 16318
  derived and/or modified CDS sequence (AUadapt) from InfluenzaA__ADA69314__NA

SEQ ID NO: 20299 - RNA, 1410 nt, Artificial Sequence; identical to SEQ ID NO: 16318
  derived and/or modified CDS sequence (AUadapt) from InfluenzaA__ADA69324__NA

SEQ ID NO: 20300 - RNA, 1410 nt, Artificial Sequence; identical to SEQ ID NO: 16318
  derived and/or modified CDS sequence (AUadapt) from InfluenzaA__ADA69334__NA

SEQ ID NO: 20301 - RNA, 1410 nt, Artificial Sequence; identical to SEQ ID NO: 16318
  derived and/or modified CDS sequence (AUadapt) from InfluenzaA__ADA69451__NA

SEQ ID NO: 20302 - RNA, 1410 nt, Artificial Sequence; identical to SEQ ID NO: 16318
  derived and/or modified CDS sequence (AUadapt) from InfluenzaA__ADA69453__NA

SEQ ID NO: 20303 - RNA, 1410 nt, Artificial Sequence
  derived and/or modified CDS sequence (AUadapt) from InfluenzaA__ADA71153__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucgcgguacgugugcuccggccuggucggcgacccgccccgcaagaacgacagcuccucguccagccacugccucgaccccaacaacgaggagggcgggcacggggugaagggcugggccuucgacgacgggaacgacgucuggaugggccggaccaucuccgagaagucccgccugggcuacgagaccuucaaggugaucgagggguggucgaaccccaagagcaagcugcagaucaaccgccaggugaucgucgaccggggcaaccgguccggguacucgggcaucuucuccguggagggcaagagcugcaucaaccgcugcuucuacguggagcucauccgggggcgcaaggaggagacggagguccuguggaccucgaacuccaucgugguguucugcggcaccagcgggaccuacggcacgggguccuggcccgacggcgccaacaucaaccugaugcccaucuga

SEQ ID NO: 20304 - RNA, 1413 nt, Artificial Sequence
  derived and/or modified CDS sequence (AUadapt) from InfluenzaA__ADA71155__NA
augaaccccaaccagaagaucaucaccaucggcucgaucuccaucgccaucgggaucaucagccugaugcuccagaucggcaacaucaucuccaucugggccagccacuccauccagaucgggucgcagaacaacaccggcaucugcaaccagcgcaucaucacguacgagaacuccaccugggugaaccacaccuacgucaacaucaacaacaccaaggugguggcgggggaggacaagacgagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggaccuucuuccugacgcagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccagcaacaaggccgccuccuacaagaucuucaagaucgagaaggggaaggugaccaagucgaucgagcucaacgcccccaacuucuacuacgaggagugcuccugcuacccggacacgggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacucgggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 20305 - RNA, 1413 nt, Artificial Sequence; identical to SEQ ID NO: 19863
  derived and/or modified CDS sequence (AUadapt) from InfluenzaA__ADA71157__NA

SEQ ID NO: 20306 - RNA, 1413 nt, Artificial Sequence
  derived and/or modified CDS sequence (AUadapt) from InfluenzaA__ADA71159__NA
augaaccccaaccagaagaucaucaccaucggcucgaucuccaucgccaucgggaucaucagccugaugcuccagaucggcaacaucaucuccaucugggccucgcacuccauccagaucgggagccagaacaacaccggcaucugcaaccagcgcaucaucacguacgagaacuccaccugggugaaccacaccuacgucaacaucaacaacaccaaggugguggcgggggagggcaagacgagcgucacccuggccggcaacuccucgcugugcuccaucagcgggugggccaucaacaccaaggacaacuccauccggaucggcagcaagggggacguguucgugauccgcgagccguucaucuccugcucgcaccucgagugccggaccuucuuccugacgcagggcgcccugcucaacgacaagcacuccaaccgcaccgucaaggaccggagccccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcggacccaggagucggagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgcgacaacuggcacgggucgaaccggcccuggguguccuucaaccagaaccuggacuaccagaucggcuacaucugcagcggcgucuucggggacaacccccgccccgaggacggcgagggguccugcaacccggugaccguggacggcgcgaacggggucaagggcuucagcuacaaguacggcaacgggguguggaucggccggaccaaguccaaccgccugcggaagggguucgagaugaucugggaccccaacggcuggacgaacaccgacucggacuucuccgugaagcaggacgucguggccaucaccgacuggagcggguacagcggcuccuucgugcagcaccccgagcucaccggccuggacugcauccgccccugcuucugggucgagcuggugcgggggcucccgcgcgagaacacgaccaucuggaccucgggcuccagcaucuccuucugcggggucaacagcgacaccgccaacugguccuggcccgacggcgccgagcugcccuucacgaucgacaaguga

SEQ ID NO: 20307 - RNA, 1410 nt, Artificial Sequence
  derived and/or modified CDS sequence (AUadapt) from InfluenzaA__ADA71161__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaaccucaugccgaucuga

SEQ ID NO: 20308 - RNA, 1413 nt, Artificial Sequence
  derived and/or modified CDS sequence (AUadapt) from InfluenzaA__ADA71165__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucagcaagaucgagaaggggaaggugaccaaguccaucgagcucaacgcccccaacuucuacuacgaggagugcucgugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucagcgugaagcaggacgucguggccaucaccgacuggucgggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 20309 - RNA, 1410 nt, Artificial Sequence
  derived and/or modified CDS sequence (AUadapt) from InfluenzaA__ADA71167__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggacauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucaaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccaacaucaaccugaugcccaucuga

SEQ ID NO: 20310 - RNA, 1413 nt, Artificial Sequence
  derived and/or modified CDS sequence (AUadapt) from InfluenzaA__ADA71169__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaucaacgggagcugcuucaccaucaugacggacggccccuccgacggggccgccucguacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucucguucaaccagaaccuggacuaccagaucggcuacaucugcuccgggguguucggcgacaacccccgcccgaaggacggggagggcagcugcaaccccgugacggucgacggggccaacggcgugaagggcuucuccuacaaguacgggaacggcguguggaucgggcggaccaagagcaaccgcauccggaagggcuucgagaugaucugggaccccaacggguggaccaacaccgacuccgacuucucggucaagcaggacaucguggcgaucacggacugguccggcuacagcggcucguucgugcagcaccccgagcugaccgggcucgacugcauccgcccgugcuucugggucgagcuggugcggggccugccccgcgagaacaccaccaucuggacguccgggagcuccaucagcuucugcggcgucaacggcgacaucgccaacugguccuggcccgacggggccgagcuccccuucaccaucgacaaguga

SEQ ID NO: 20311 - RNA, 1413 nt, Artificial Sequence; identical to SEQ ID NO: 19863
  derived and/or modified CDS sequence (AUadapt) from InfluenzaA__ADA71171__NA

SEQ ID NO: 20312 - RNA, 1410 nt, Artificial Sequence
  derived and/or modified CDS sequence (AUadapt) from InfluenzaA__ADA71173__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgcccggaccccguaccgcacccugcucaugaacgagcugggcgugcccuuccaccugggcacgaagcaggucugcaucgccuggagcuccucguccugccacgacgggaaggcguggcuccacgugugcaucaccggcgacgacaagaacgccaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggcggacaccaagauccucuucaucgaggagggcaagaucgugcacacgagcacccuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucaaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 20313 - RNA, 1413 nt, Artificial Sequence
  derived and/or modified CDS sequence (AUadapt) from InfluenzaA__ADA71175__NA
augaaccccaaccagaagaucaucaccaucggcucgaucuccaucgccaucgggaucaucagccugaugcuccagaucggcaacaucaucuccaucugggccucgcacuccauccagaucgggagccagaacaacaccggcaucugcaaccagcgcaucaucacguacgagaacuccaccugggugaaccacaccuacgucaacaucaacaacaccaaggugguggcgggggaggacaagacgagcgucacccuggccggcaacuccucgcugugcuccaucagcggcugggccaucaacaccaaggacaacuccauccggaucgggagcaagggcgacguguucgugauccgcgagccguucaucuccugcucgcaccucgagugccggaccuucuuccugacgcagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagucggagugcgugugcaugaacggguccugcuucaccaucaugaccgacggccccagcaacaaggccgccuccuacaagaucuucaagaucgagaaggggaaggugaccaagagcaucgagcucaacgcccccaacuucuacuacgaggagugcuccugcuacccggacacgggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacucggacuucuccgugaagcaggacgucguggccaucaccgacuggagcggguacagcggcuccuucgugcagcaccccgagcucaccggccuggacugcauccggcccugcuucugggucgagcuggugcgcgggcucccgcgggagaacacgaccaucuggaccucgggcuccagcaucuccuucugcggggucaacagcgacaccgccaacugguccuggcccgacggcgccgagcugcccuucacgaucgacaaguga

SEQ ID NO: 20314 - RNA, 1413 nt, Artificial Sequence; identical to SEQ ID NO: 19863
  derived and/or modified CDS sequence (AUadapt) from InfluenzaA__ADA71177__NA

SEQ ID NO: 20315 - RNA, 1410 nt, Artificial Sequence
  derived and/or modified CDS sequence (AUadapt) from InfluenzaA__ADA71193__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20316 - RNA, 1410 nt, Artificial Sequence
  derived and/or modified CDS sequence (AUadapt) from InfluenzaA__ADA79589__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggucguccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaagagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20317 - RNA, 1410 nt, Artificial Sequence
  derived and/or modified CDS sequence (AUadapt) from InfluenzaA__ADA79599__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20318 - RNA, 1410 nt, Artificial Sequence; identical to SEQ ID NO: 20317
  derived and/or modified CDS sequence (AUadapt) from InfluenzaA__ADA79609__NA

SEQ ID NO: 20319 - RNA, 1410 nt, Artificial Sequence
  derived and/or modified CDS sequence (AUadapt) from InfluenzaA__ADA79619__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggccuccgucaagcuggccgggaacucgucccucugcccggugagcggcugggccaucuacuccaaggacaacagcauccgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggcgugguccgccucggccugccacgacgggaucaacuggcucaccaucggcaucuccggccccgacaacggggccgucgcggugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 20320 - RNA, 1410 nt, Artificial Sequence; identical to SEQ ID NO: 16318
  derived and/or modified CDS sequence (AUadapt) from InfluenzaA__ADA81211__NA

SEQ ID NO: 20321 - RNA, 1410 nt, Artificial Sequence
  derived and/or modified CDS sequence (AUadapt) from InfluenzaA__ADA83035__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugcuccaccuucuuccugacccagggcgcccuccugaacgacaagcacuccaacgggaccaucaaggaccgcucgcccuaccggacgcugauguccugcccgaucggcgagguccccagccccuacaacagccgcuucgaguccguggccuggagcgcguccgccugccacgacgggaucaacuggcucaccaucggcaucagcggccccgacaacggggccguggccguccugaaguacaacggcaucaucaccgacaccaucaaguccuggcggaacaacauccugcgcacgcaggagucggagugcgcgugcgugaacggguccugcuucaccgugaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 20322 - RNA, 1410 nt, Artificial Sequence
  derived and/or modified CDS sequence (AUadapt) from InfluenzaA__ADA83037__NA
augaaccccaaccagaagaucaucaccaucggcucggugugcaugaccaucgggauggccaaccugauccuccagaucggcaacaucaucuccaucuggaucagccacuccauccagcuggggaaccaggaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20323 - RNA, 1410 nt, Artificial Sequence; identical to SEQ ID NO: 16318
  derived and/or modified CDS sequence (AUadapt) from InfluenzaA__ADA83588__NA

SEQ ID NO: 20324 - RNA, 1410 nt, Artificial Sequence; identical to SEQ ID NO: 16318
  derived and/or modified CDS sequence (AUadapt) from InfluenzaA__ADA83592__NA

SEQ ID NO: 20325 - RNA, 1410 nt, Artificial Sequence; identical to SEQ ID NO: 16318
  derived and/or modified CDS sequence (AUadapt) from InfluenzaA__ADA83596__NA

SEQ ID NO: 20326 - RNA, 1410 nt, Artificial Sequence; identical to SEQ ID NO: 16318
  derived and/or modified CDS sequence (AUadapt) from InfluenzaA__ADA83600__NA

SEQ ID NO: 20327 - RNA, 1410 nt, Artificial Sequence; identical to SEQ ID NO: 16318
  derived and/or modified CDS sequence (AUadapt) from InfluenzaA__ADA83604__NA

SEQ ID NO: 20328 - RNA, 1410 nt, Artificial Sequence; identical to SEQ ID NO: 16318
  derived and/or modified CDS sequence (AUadapt) from InfluenzaA__ADA83608__NA

SEQ ID NO: 20329 - RNA, 1410 nt, Artificial Sequence; identical to SEQ ID NO: 16318
  derived and/or modified CDS sequence (AUadapt) from InfluenzaA__ADA83612__NA

SEQ ID NO: 20330 - RNA, 1410 nt, Artificial Sequence; identical to SEQ ID NO: 19494
  derived and/or modified CDS sequence (AUadapt) from InfluenzaA__ADA83616__NA

SEQ ID NO: 20331 - RNA, 1410 nt, Artificial Sequence; identical to SEQ ID NO: 16318
  derived and/or modified CDS sequence (AUadapt) from InfluenzaA__ADA83624__NA

SEQ ID NO: 20332 - RNA, 1410 nt, Artificial Sequence; identical to SEQ ID NO: 16318
  derived and/or modified CDS sequence (AUadapt) from InfluenzaA__ADA83630__NA

SEQ ID NO: 20333 - RNA, 1410 nt, Artificial Sequence; identical to SEQ ID NO: 16318
  derived and/or modified CDS sequence (AUadapt) from InfluenzaA__ADA83634__NA

SEQ ID NO: 20334 - RNA, 1410 nt, Artificial Sequence; identical to SEQ ID NO: 16318
  derived and/or modified CDS sequence (AUadapt) from InfluenzaA__ADA83638__NA

SEQ ID NO: 20335 - RNA, 1410 nt, Artificial Sequence; identical to SEQ ID NO: 16318
  derived and/or modified CDS sequence (AUadapt) from InfluenzaA__ADA83642__NA

SEQ ID NO: 20336 - RNA, 1410 nt, Artificial Sequence; identical to SEQ ID NO: 16318
  derived and/or modified CDS sequence (AUadapt) from InfluenzaA__ADA83649__NA

SEQ ID NO: 20337 - RNA, 1410 nt, Artificial Sequence; identical to SEQ ID NO: 16318
  derived and/or modified CDS sequence (AUadapt) from InfluenzaA__ADA83653__NA

SEQ ID NO: 20338 - RNA, 1410 nt, Artificial Sequence; identical to SEQ ID NO: 16318
  derived and/or modified CDS sequence (AUadapt) from InfluenzaA__ADA83657__NA

SEQ ID NO: 20339 - RNA, 1410 nt, Artificial Sequence; identical to SEQ ID NO: 16318
  derived and/or modified CDS sequence (AUadapt) from InfluenzaA__ADA83661__NA

SEQ ID NO: 20340 - RNA, 1410 nt, Artificial Sequence; identical to SEQ ID NO: 16318
  derived and/or modified CDS sequence (AUadapt) from InfluenzaA__ADA83669__NA

SEQ ID NO: 20341 - RNA, 1410 nt, Artificial Sequence; identical to SEQ ID NO: 16318
  derived and/or modified CDS sequence (AUadapt) from InfluenzaA__ADA83673__NA

SEQ ID NO: 20342 - RNA, 1410 nt, Artificial Sequence; identical to SEQ ID NO: 16318
  derived and/or modified CDS sequence (AUadapt) from InfluenzaA__ADA83677__NA

SEQ ID NO: 20343 - RNA, 1410 nt, Artificial Sequence; identical to SEQ ID NO: 16318
  derived and/or modified CDS sequence (AUadapt) from InfluenzaA__ADA83681__NA

SEQ ID NO: 20344 - RNA, 1410 nt, Artificial Sequence; identical to SEQ ID NO: 16318
  derived and/or modified CDS sequence (AUadapt) from InfluenzaA__ADA83685__NA

SEQ ID NO: 20345 - RNA, 1410 nt, Artificial Sequence; identical to SEQ ID NO: 16318
  derived and/or modified CDS sequence (AUadapt) from InfluenzaA__ADA86069__NA

SEQ ID NO: 20346 - RNA, 1410 nt, Artificial Sequence; identical to SEQ ID NO: 16318
  derived and/or modified CDS sequence (AUadapt) from InfluenzaA__ADB27973__NA

SEQ ID NO: 20347 - RNA, 1410 nt, Artificial Sequence; identical to SEQ ID NO: 16318
  derived and/or modified CDS sequence (AUadapt) from InfluenzaA__ADB27983__NA

SEQ ID NO: 20348 - RNA, 1410 nt, Artificial Sequence
  derived and/or modified CDS sequence (AUadapt) from InfluenzaA__ADB66693__NA
augaaccccaaccagaagaucaucaccaucggcucggugugcaugaccaucgggauggccaaccugauccuccagaucggcaacaucaucuccaucuggaucauccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20349 - RNA, 1410 nt, Artificial Sequence; identical to SEQ ID NO: 16318
  derived and/or modified CDS sequence (AUadapt) from InfluenzaA__ADB66695__NA

SEQ ID NO: 20350 - RNA, 1410 nt, Artificial Sequence; identical to SEQ ID NO: 16318
  derived and/or modified CDS sequence (AUadapt) from InfluenzaA__ADB66696__NA

SEQ ID NO: 20351 - RNA, 1410 nt, Artificial Sequence
  derived and/or modified CDS sequence (AUadapt) from InfluenzaA__ADB66697__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacgagcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccggaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucucgaucaagcaggacaucgugggcauccacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 20352 - RNA, 1410 nt, Artificial Sequence; identical to SEQ ID NO: 20315
  derived and/or modified CDS sequence (AUadapt) from InfluenzaA__ADB81401__NA

SEQ ID NO: 20353 - RNA, 1410 nt, Artificial Sequence; identical to SEQ ID NO: 20158
  derived and/or modified CDS sequence (AUadapt) from InfluenzaA__ADB81421__NA

SEQ ID NO: 20354 - RNA, 1410 nt, Artificial Sequence; identical to SEQ ID NO: 19494
  derived and/or modified CDS sequence (AUadapt) from InfluenzaA__ADB81431__NA

SEQ ID NO: 20355 - RNA, 1410 nt, Artificial Sequence; identical to SEQ ID NO: 16318
  derived and/or modified CDS sequence (AUadapt) from InfluenzaA__ADB81441__NA

SEQ ID NO: 20356 - RNA, 1410 nt, Artificial Sequence
  derived and/or modified CDS sequence (AUadapt) from InfluenzaA__ADB81451__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaaguucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20357 - RNA, 1410 nt, Artificial Sequence; identical to SEQ ID NO: 20317
  derived and/or modified CDS sequence (AUadapt) from InfluenzaA__ADB81461__NA

SEQ ID NO: 20358 - RNA, 1410 nt, Artificial Sequence; identical to SEQ ID NO: 20317
  derived and/or modified CDS sequence (AUadapt) from InfluenzaA__ADB82942__NA

SEQ ID NO: 20359 - RNA, 1410 nt, Artificial Sequence; identical to SEQ ID NO: 19295
  derived and/or modified CDS sequence (AUadapt) from InfluenzaA__ADB82945__NA

SEQ ID NO: 20360 - RNA, 1410 nt, Artificial Sequence; identical to SEQ ID NO: 16318
  derived and/or modified CDS sequence (AUadapt) from InfluenzaA__ADB89132__NA

SEQ ID NO: 20361 - RNA, 1410 nt, Artificial Sequence; identical to SEQ ID NO: 19723
  derived and/or modified CDS sequence (AUadapt) from InfluenzaA__ADB89142__NA

SEQ ID NO: 20362 - RNA, 1410 nt, Artificial Sequence; identical to SEQ ID NO: 16318
  derived and/or modified CDS sequence (AUadapt) from InfluenzaA__ADB89224__NA

SEQ ID NO: 20363 - RNA, 1410 nt, Artificial Sequence
  derived and/or modified CDS sequence (AUadapt) from InfluenzaA__ADB89234__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugucgggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucggucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 20364 - RNA, 1410 nt, Artificial Sequence; identical to SEQ ID NO: 16274
  derived and/or modified CDS sequence (AUadapt) from InfluenzaA__ADB89244__NA

SEQ ID NO: 20365 - RNA, 1410 nt, Artificial Sequence; identical to SEQ ID NO: 16318
  derived and/or modified CDS sequence (AUadapt) from InfluenzaA__ADB89264__NA

SEQ ID NO: 20366 - RNA, 1410 nt, Artificial Sequence; identical to SEQ ID NO: 20110
  derived and/or modified CDS sequence (AUadapt) from InfluenzaA__ADB89274__NA

SEQ ID NO: 20367 - RNA, 1410 nt, Artificial Sequence; identical to SEQ ID NO: 19295
  derived and/or modified CDS sequence (AUadapt) from InfluenzaA__ADB89284__NA

SEQ ID NO: 20368 - RNA, 1410 nt, Artificial Sequence; identical to SEQ ID NO: 16318
  derived and/or modified CDS sequence (AUadapt) from InfluenzaA__ADB89294__NA

SEQ ID NO: 20369 - RNA, 1410 nt, Artificial Sequence; identical to SEQ ID NO: 16318
  derived and/or modified CDS sequence (AUadapt) from InfluenzaA__ADB89304__NA

SEQ ID NO: 20370 - RNA, 1410 nt, Artificial Sequence; identical to SEQ ID NO: 16318
  derived and/or modified CDS sequence (AUadapt) from InfluenzaA__ADB89314__NA

SEQ ID NO: 20371 - RNA, 1410 nt, Artificial Sequence; identical to SEQ ID NO: 16318
  derived and/or modified CDS sequence (AUadapt) from InfluenzaA__ADB89324__NA

SEQ ID NO: 20372 - RNA, 1410 nt, Artificial Sequence; identical to SEQ ID NO: 16318
  derived and/or modified CDS sequence (AUadapt) from InfluenzaA__ADB89334__NA

SEQ ID NO: 20373 - RNA, 1410 nt, Artificial Sequence; identical to SEQ ID NO: 16318
  derived and/or modified CDS sequence (AUadapt) from InfluenzaA__ADB89344__NA

SEQ ID NO: 20374 - RNA, 1410 nt, Artificial Sequence; identical to SEQ ID NO: 16318
  derived and/or modified CDS sequence (AUadapt) from InfluenzaA__ADB89364__NA

SEQ ID NO: 20375 - RNA, 1410 nt, Artificial Sequence; identical to SEQ ID NO: 16318
  derived and/or modified CDS sequence (AUadapt) from InfluenzaA__ADB89374__NA

SEQ ID NO: 20376 - RNA, 1410 nt, Artificial Sequence; identical to SEQ ID NO: 16318
  derived and/or modified CDS sequence (AUadapt) from InfluenzaA__ADB89384__NA

SEQ ID NO: 20377 - RNA, 1410 nt, Artificial Sequence; identical to SEQ ID NO: 16318
  derived and/or modified CDS sequence (AUadapt) from InfluenzaA__ADB89394__NA

SEQ ID NO: 20378 - RNA, 1410 nt, Artificial Sequence
  derived and/or modified CDS sequence (AUadapt) from InfluenzaA__ADB89404__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacucgaacgggaccaucaaggaccggucccccuaccgcacgcugaugagcugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagucguggcgcaacuccauccugcggacgcaggagagcgagugcgcgugcgugaacggguccugcuucaccgucaugaccgacggcccgagcaacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 20379 - RNA, 1410 nt, Artificial Sequence; identical to SEQ ID NO: 16318
  derived and/or modified CDS sequence (AUadapt) from InfluenzaA__ADB89414__NA

SEQ ID NO: 20380 - RNA, 1410 nt, Artificial Sequence; identical to SEQ ID NO: 16318
  derived and/or modified CDS sequence (AUadapt) from InfluenzaA__ADB89424__NA

SEQ ID NO: 20381 - RNA, 1410 nt, Artificial Sequence; identical to SEQ ID NO: 16318
  derived and/or modified CDS sequence (AUadapt) from InfluenzaA__ADB89434__NA

SEQ ID NO: 20382 - RNA, 1410 nt, Artificial Sequence; identical to SEQ ID NO: 16318
  derived and/or modified CDS sequence (AUadapt) from InfluenzaA__ADB89444__NA

SEQ ID NO: 20383 - RNA, 1410 nt, Artificial Sequence
  derived and/or modified CDS sequence (AUadapt) from InfluenzaA__ADB89454__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20384 - RNA, 1410 nt, Artificial Sequence; identical to SEQ ID NO: 16318
  derived and/or modified CDS sequence (AUadapt) from InfluenzaA__ADB89464__NA

SEQ ID NO: 20385 - RNA, 1410 nt, Artificial Sequence; identical to SEQ ID NO: 16318
  derived and/or modified CDS sequence (AUadapt) from InfluenzaA__ADB89484__NA

SEQ ID NO: 20386 - RNA, 1410 nt, Artificial Sequence; identical to SEQ ID NO: 16318
  derived and/or modified CDS sequence (AUadapt) from InfluenzaA__ADB89494__NA

SEQ ID NO: 20387 - RNA, 1410 nt, Artificial Sequence; identical to SEQ ID NO: 16274
  derived and/or modified CDS sequence (AUadapt) from InfluenzaA__ADB89504__NA

SEQ ID NO: 20388 - RNA, 1410 nt, Artificial Sequence; identical to SEQ ID NO: 16318
  derived and/or modified CDS sequence (AUadapt) from InfluenzaA__ADB89514__NA

SEQ ID NO: 20389 - RNA, 1410 nt, Artificial Sequence; identical to SEQ ID NO: 16318
  derived and/or modified CDS sequence (AUadapt) from InfluenzaA__ADB89524__NA

SEQ ID NO: 20390 - RNA, 1410 nt, Artificial Sequence
  derived and/or modified CDS sequence (AUadapt) from InfluenzaA__ADB89544__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcucccugcuggagugccgcaccuucuuccucacccagggcgcccugcugaacgacaagcacagcaacgggaccaucaaggaccggucccccuaccgcacgcucaugagcugccccaucggcgaggucccgucccccuacaacagccgguucgagucgguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccucgacugcauccgcccgugcuucugggucgagcugauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 20391 - RNA, 1410 nt, Artificial Sequence; identical to SEQ ID NO: 16318
  derived and/or modified CDS sequence (AUadapt) from InfluenzaA__ADB89564__NA

SEQ ID NO: 20392 - RNA, 1410 nt, Artificial Sequence; identical to SEQ ID NO: 16318
  derived and/or modified CDS sequence (AUadapt) from InfluenzaA__ADB89574__NA

SEQ ID NO: 20393 - RNA, 1410 nt, Artificial Sequence; identical to SEQ ID NO: 16318
  derived and/or modified CDS sequence (AUadapt) from InfluenzaA__ADB89594__NA

SEQ ID NO: 20394 - RNA, 1410 nt, Artificial Sequence; identical to SEQ ID NO: 16318
  derived and/or modified CDS sequence (AUadapt) from InfluenzaA__ADB89604__NA

SEQ ID NO: 20395 - RNA, 1410 nt, Artificial Sequence
  derived and/or modified CDS sequence (AUadapt) from InfluenzaA__ADB89614__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacgggaucuggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20396 - RNA, 1410 nt, Artificial Sequence; identical to SEQ ID NO: 16318
  derived and/or modified CDS sequence (AUadapt) from InfluenzaA__ADB89624__NA

SEQ ID NO: 20397 - RNA, 1410 nt, Artificial Sequence; identical to SEQ ID NO: 16318
  derived and/or modified CDS sequence (AUadapt) from InfluenzaA__ADB89634__NA

SEQ ID NO: 20398 - RNA, 1410 nt, Artificial Sequence; identical to SEQ ID NO: 16318
  derived and/or modified CDS sequence (AUadapt) from InfluenzaA__ADB89644__NA

SEQ ID NO: 20399 - RNA, 1410 nt, Artificial Sequence; identical to SEQ ID NO: 20158
  derived and/or modified CDS sequence (AUadapt) from InfluenzaA__ADB89664__NA

SEQ ID NO: 20400 - RNA, 1410 nt, Artificial Sequence; identical to SEQ ID NO: 16318
  derived and/or modified CDS sequence (AUadapt) from InfluenzaA__ADB89674__NA

SEQ ID NO: 20401 - RNA, 1410 nt, Artificial Sequence; identical to SEQ ID NO: 16318
  derived and/or modified CDS sequence (AUadapt) from InfluenzaA__ADB89684__NA

SEQ ID NO: 20402 - RNA, 1410 nt, Artificial Sequence
  derived and/or modified CDS sequence (AUadapt) from InfluenzaA__ADB89694__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucacgaucaagcaggacaucguggggaucaacgaguggagcggcuacuccgggucguucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 20403 - RNA, 1410 nt, Artificial Sequence; identical to SEQ ID NO: 16318
  derived and/or modified CDS sequence (AUadapt) from InfluenzaA__ADB89704__NA

SEQ ID NO: 20404 - RNA, 1410 nt, Artificial Sequence; identical to SEQ ID NO: 16318
  derived and/or modified CDS sequence (AUadapt) from InfluenzaA__ADB89714__NA

SEQ ID NO: 20405 - RNA, 1410 nt, Artificial Sequence; identical to SEQ ID NO: 19001
  derived and/or modified CDS sequence (AUadapt) from InfluenzaA__ADB89724__NA

SEQ ID NO: 20406 - RNA, 1410 nt, Artificial Sequence; identical to SEQ ID NO: 19001
  derived and/or modified CDS sequence (AUadapt) from InfluenzaA__ADB89735__NA

SEQ ID NO: 20407 - RNA, 1410 nt, Artificial Sequence; identical to SEQ ID NO: 16318
  derived and/or modified CDS sequence (AUadapt) from InfluenzaA__ADB90357__NA

SEQ ID NO: 20408 - RNA, 1410 nt, Artificial Sequence; identical to SEQ ID NO: 16318
  derived and/or modified CDS sequence (AUadapt) from InfluenzaA__ADB90358__NA

SEQ ID NO: 20409 - RNA, 1410 nt, Artificial Sequence
  derived and/or modified CDS sequence (AUadapt) from InfluenzaA__ADB90359__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgucggccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccggaucggguacaucugcuccggcaucuucggggacaacccgcgccccaacgacaagaccggcagcugcggccccgucuccucgaacggggccaacggcgugaagggguucuccuucaaguacggcaacgggguguggaucggccggaccaagagcaucagcucccgcaacggcuucgagaugaucugggaccccaacggguggaccggcaccgacaacaacuucagcaucaagcaggacaucgucgggacgaacgagugguccggcuacucgggguccuucgugcagcacccggagcugaccggccuggacugcauccggcccugcuucuggguggagcucauccgcggccggcccaaggagaacaccaucuggaccagcggguccagcaucuccuucugcggcgucaacagcgacacgguggggugguccuggcccgacggcgccgagcugccguucaccaucgacaaguga

SEQ ID NO: 20410 - RNA, 1410 nt, Artificial Sequence; identical to SEQ ID NO: 16318
  derived and/or modified CDS sequence (AUadapt) from InfluenzaA__ADB90363__NA

SEQ ID NO: 20411 - RNA, 1410 nt, Artificial Sequence; identical to SEQ ID NO: 20317
  derived and/or modified CDS sequence (AUadapt) from InfluenzaA__ADB90373__NA

SEQ ID NO: 20412 - RNA, 1410 nt, Artificial Sequence; identical to SEQ ID NO: 16318
  derived and/or modified CDS sequence (AUadapt) from InfluenzaA__ADB98137__NA

SEQ ID NO: 20413 - RNA, 1410 nt, Artificial Sequence; identical to SEQ ID NO: 19494
  derived and/or modified CDS sequence (AUadapt) from InfluenzaA__ADB98138__NA

SEQ ID NO: 20414 - RNA, 1410 nt, Artificial Sequence; identical to SEQ ID NO: 16318
  derived and/or modified CDS sequence (AUadapt) from InfluenzaA__ADB98139__NA

SEQ ID NO: 20415 - RNA, 1410 nt, Artificial Sequence; identical to SEQ ID NO: 19494
  derived and/or modified CDS sequence (AUadapt) from InfluenzaA__ADB98140__NA

SEQ ID NO: 20416 - RNA, 1410 nt, Artificial Sequence; identical to SEQ ID NO: 19494
  derived and/or modified CDS sequence (AUadapt) from InfluenzaA__ADB98141__NA

SEQ ID NO: 20417 - RNA, 1410 nt, Artificial Sequence; identical to SEQ ID NO: 16318
  derived and/or modified CDS sequence (AUadapt) from InfluenzaA__ADC32391__NA

SEQ ID NO: 20418 - RNA, 1410 nt, Artificial Sequence; identical to SEQ ID NO: 16318
  derived and/or modified CDS sequence (AUadapt) from InfluenzaA__ADC32392__NA

SEQ ID NO: 20419 - RNA, 1410 nt, Artificial Sequence; identical to SEQ ID NO: 16318
  derived and/or modified CDS sequence (AUadapt) from InfluenzaA__ADC32393__NA

SEQ ID NO: 20420 - RNA, 1410 nt, Artificial Sequence; identical to SEQ ID NO: 16318
  derived and/or modified CDS sequence (AUadapt) from InfluenzaA__ADC32394__NA

SEQ ID NO: 20421 - RNA, 1410 nt, Artificial Sequence; identical to SEQ ID NO: 16318
  derived and/or modified CDS sequence (AUadapt) from InfluenzaA__ADC32395__NA

SEQ ID NO: 20422 - RNA, 1410 nt, Artificial Sequence; identical to SEQ ID NO: 16318
  derived and/or modified CDS sequence (AUadapt) from InfluenzaA__ADC32396__NA

SEQ ID NO: 20423 - RNA, 1410 nt, Artificial Sequence; identical to SEQ ID NO: 16318
  derived and/or modified CDS sequence (AUadapt) from InfluenzaA__ADC32397__NA

SEQ ID NO: 20424 - RNA, 1410 nt, Artificial Sequence; identical to SEQ ID NO: 16318
  derived and/or modified CDS sequence (AUadapt) from InfluenzaA__ADC32398__NA

SEQ ID NO: 20425 - RNA, 1410 nt, Artificial Sequence; identical to SEQ ID NO: 16318
  derived and/or modified CDS sequence (AUadapt) from InfluenzaA__ADC32399__NA

SEQ ID NO: 20426 - RNA, 1410 nt, Artificial Sequence; identical to SEQ ID NO: 16318
  derived and/or modified CDS sequence (AUadapt) from InfluenzaA__ADC32400__NA

SEQ ID NO: 20427 - RNA, 1410 nt, Artificial Sequence; identical to SEQ ID NO: 16318
  derived and/or modified CDS sequence (AUadapt) from InfluenzaA__ADC32401__NA

SEQ ID NO: 20428 - RNA, 1410 nt, Artificial Sequence
  derived and/or modified CDS sequence (AUadapt) from InfluenzaA__ADC32404__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20429 - RNA, 1410 nt, Artificial Sequence
  derived and/or modified CDS sequence (AUadapt) from InfluenzaA__ADC32407__NA
augaaccccaagcagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20430 - RNA, 1410 nt, Artificial Sequence
  derived and/or modified CDS sequence (AUadapt) from InfluenzaA__ADC34942__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccgggagugguccaagccccagugcaacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacgacaucguccgcgaccggacccccuaccgcacccugcucaugaacgagcugggcgugcccuuccaccugggcaccaagcaggucugcaucgccugguccagcuccucgugccacgacgggaaggccuggcuccacgugugcgugacgggcgacgacaagaacgcgaccgccuccuucaucuacaacgggcggcugguggacagcaucgucuccuggucgaaggagauccugcgcacccaggaguccgagugcgugugcaucaacgggaccugcacgguggucaugaccgacggcagcgccuccggcaaggccgacaccaagauccucuucaucgaggagggcaagaucgugcacaccucgacgcugagcggguccgcgcagcacguggaggagugcagcugcuacccccgguacccgggcguccgcugcgugugccgggacaacuggcgcggguccaaccggcccaucguggacaucaacaugaaggacuacucgaucgucuccagcuacgugugcuccggccuggugggcgacacgccccgcaagaacgacucguccagcuccgggcacugccucaaccccaacaacgaggagggcgggcacggcgucaaggggugggccuucgacgacggcaacgacguguggaugggccggaccaucucggagaagcugcgcuccggguacgagaccuucaaggucaucgagggcuggagcaacccgaacuccaagcugcagaucaaccgccaggugaucguggaccgggggaaccggucgggcuacuccgggaucuucagcgucgagggcaaguccugcaucaaccgcugcuucuacguggagcucauccggggccgcaaggaggagaccgaggugcuguggaccucgaacagcaucgucguguucugcgggaccuccggcaccuacgggacgggcagcuggcccgacggggccgacaucaaccugaugcccaucuga

SEQ ID NO: 20431 - RNA, 1410 nt, Artificial Sequence
  derived and/or modified CDS sequence (AUadapt) from InfluenzaA__ADC39000__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaacgucgggugguccuggcccgacggcgccgagcugccguucaccaucgacaaguga

SEQ ID NO: 20432 - RNA, 1410 nt, Artificial Sequence; identical to SEQ ID NO: 16318
  derived and/or modified CDS sequence (AUadapt) from InfluenzaA__ADC39010__NA

SEQ ID NO: 20433 - RNA, 1413 nt, Artificial Sequence; identical to SEQ ID NO: 19034
  derived and/or modified CDS sequence (AUadapt) from InfluenzaA__ADC45606__NA

SEQ ID NO: 20434 - RNA, 1413 nt, Artificial Sequence
  derived and/or modified CDS sequence (AUadapt) from InfluenzaA__ADC45628__NA
augaaccccaaccagaagaucaucaccaucggcucgaucuccaucgccaucgggaucaucagccugaugcuccagaugggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccucguacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucucguucaaccagaaccuggacuaccagaucggcuacaucugcuccgggguguucggcgacaacccccgcccgaaggaccgggaggggagcugcaaccccgugacggucgacggcgccaacggggugaagggcuucuccuacaaguacggcaacgggguguggaucggccgcaccaagagcaaccggauccgcaagggguucgagaugaucugggaccccaacggcuggaccaacaccgacuccgacuucucggucaagcaggacaucguggcgaucacggacugguccggguacagcggcucguucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 20435 - RNA, 1413 nt, Artificial Sequence
  derived and/or modified CDS sequence (AUadapt) from InfluenzaA__ADC45639__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucggggucuccggccccgacaacggggccguggcggugcugaaguacaagggcaucaucacgggcaccaucaagagcuggaagaagcagauccugcggacccaggaguccgagugcgucugcaugaacgggagcugcuucaccaucaugacggacggccccuccaacggggccgccucguacaagaucuucaagaucgagaagggcaaggugaccaaguccauggagcucaacgccccgaacuuccacuacgaggagugcagcugcuaccccgacaccgggaccgugaugugcgucugccgcgacaacuggcacggcuccaaccggcccugggugucguucaaccagaaccuggacuaccagaucggcuacaucugcuccgggguguucggcgacaacccccgcccgaaggaccgggaggggagcugcaaccccgucacgguggacggcgccaacggggugaagggcuucuccuacaaguacggcaacggggucuggaucggccgcaccaagagcaaccggauccgcaagggguucgagaugaucugggaccccaacggcuggaccaacaccgacuccgacuucucggugaagcaggacaucguggcgaucacggacugguccggguacagcggcucguucguccagcaccccgagcugaccggccucgacugcauccggccgugcuucuggguggagcugguccgcgggcugccccgggagaacaccaccaucuggacguccggcagcuccaucagcuucugcggggugaacggcgacaucgccaacugguccuggcccgacggcgccgagcuccccuucaccaucgacaaguga

SEQ ID NO: 20436 - RNA, 1413 nt, Artificial Sequence; identical to SEQ ID NO: 19034
  derived and/or modified CDS sequence (AUadapt) from InfluenzaA__ADC45650__NA

SEQ ID NO: 20437 - RNA, 1413 nt, Artificial Sequence; identical to SEQ ID NO: 19034
  derived and/or modified CDS sequence (AUadapt) from InfluenzaA__ADC45661__NA

SEQ ID NO: 20438 - RNA, 1413 nt, Artificial Sequence
  derived and/or modified CDS sequence (AUadapt) from InfluenzaA__ADC45683__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcgggggaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccucguacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucucguucaaccagaaccuggacuaccagaucggcuacaucugcuccgggguguucggcgacaacccccgcccgaaggaccgggaggggagcugcaaccccgugacggucgacggcgccaacggggugaagggcuucuccuacaaguacggcaacgggguguggaucggccgcaccaagagcaaccggauccgcaagggguucgagaugaucugggaccccaacggcuggaccaacaccgacuccgacuucucggucaagcaggacaucguggcgaucacggacugguccggguacagcggcucguucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 20439 - RNA, 1413 nt, Artificial Sequence
  derived and/or modified CDS sequence (AUadapt) from InfluenzaA__ADC45705__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaagaaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 20440 - RNA, 1413 nt, Artificial Sequence
  derived and/or modified CDS sequence (AUadapt) from InfluenzaA__ADC45716__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccccggucacccuggugggcaacagcucccugugcucgaucuccggcugggccaucuacaccaaggacaacagcauccggaucggguccaagggcgacguguucgucauccgcgagcccuucaucucgugcucccaccucgagugcaagacguucuuccugacccagggggcccugcucaacgacaagcacagcaacggcaccgugaaggaccggucccccuaccgcgcccugaugagcugcccccugggggaggccccgucccccuacaacucgaaguucgagagcguggcgugguccgccucggccugccacgacggcaucggcuggcucaccaucgggaucuccggccccgacaacggggccgucgcggugcugaaguacaagggcaucaucacgggcaccaucaagagcuggaagaagcagauccugcggacccaggaguccgagugcgugugcaugaacgggagcugcuucaccaucaugacggacggccccuccaacggggccgccucguacaagaucuucaagaucgagaagggcaaggucaccaaguccauggagcucaacgccccgaacuuccacuacgaggagugcagcugcuaccccgacaccgggaccgugaugugcgugugccgcgacaacuggcacggcuccaaccggcccugggucucguucaaccagaaccuggacuaccagaucggcuacaucugcuccgggguguucggcgacaacccccgcccgaaggaccgggaggggagcugcaaccccgugacggucgacggcgccaacgggguggagggcuucuccuacaaguacggcaacgggguguggaucggccgcaccaagagcaaccggauccgcaagggguucgagaugaucugggaccccaacggcuggaccaacaccgacuccgacuucucggucaagcaggacaucguggcgaucacgaacugguccggguacagcggcucguucgugcagcaccccgagcugaccggccucgacugcauccggccgugcuucugggucgagcuggugcgcgggcugccccgggagaacaccaccaucuggacguccggcagcuccaucagcuucugcggggucaacggcgacaucgccaacugguccuggcccgacggcgccgagcuccccuucaccaucgacaaguga

SEQ ID NO: 20441 - RNA, 1413 nt, Artificial Sequence
  derived and/or modified CDS sequence (AUadapt) from InfluenzaA__ADC45738__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 20442 - RNA, 1413 nt, Artificial Sequence
  derived and/or modified CDS sequence (AUadapt) from InfluenzaA__ADC45760__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgccaaggaccgcagccccuaccgggcgcugauguccugcccccugggggaggcccccucgccguacaacagcaaguucgaguccgucgccuggagcgccuccgcgugccacgacggcaugggcuggcucaccaucgggaucucgggccccgacaacggggccguggccgugcugaaguacaacggcaucaucacgggcaccaucaaguccuggaagaagcagauccugcgcacccaggagagcgagugcgucugcaugaacggguccugcuucaccaucaugacggacggccccucgaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcucgggcguguucggggacaacccccggcccgaggacggcgagggguccugcaacccggucaccguggacggcgccaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggggugcauccggcccugcuucuggguggagcugguccgcggccucccgcgggagaacaccaccaucuggaccucgggguccagcaucuccuucugcggcgugaacagcgacacggccaacugguccuggcccgacggcgccgagcugcccuucaccaucgacaaguga

SEQ ID NO: 20443 - RNA, 1413 nt, Artificial Sequence
  derived and/or modified CDS sequence (AUadapt) from InfluenzaA__ADC45771__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccaugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 20444 - RNA, 1413 nt, Artificial Sequence
  derived and/or modified CDS sequence (AUadapt) from InfluenzaA__ADC45782__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaaccgcaccgucaaggaccggagccccuaccgcgcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcggacccaggagucggagugcgugugcgugaacggcuccugcuucaccaucaugacggacgggcccagcaacaaggccgccuccuacaagaucuucaagaucgagaagggcaaggucaccaagagcaucgagcucaacgcccccaacuucuacuacgaggagugcuccugcuacccggacaccgggaucgugaugugcgugugccgcgacaacuggcacggcucgaaccggcccugggucuccuucaaccagaaccuggacuaccagaucggguacaucugcagcggcguguucggcgacaacccccgccccgaggacggggagggcuccugcaacccggugaccgucgacggggcgaacggcgugaagggguucagcuacaaguacggcaacggcguguggaucgggcggacgaaguccaaccgccugcggaagggcuucgagaugaucugggaccccaacggguggaccaacaccgacucggacuucuccgucaagcaggacgugguggccaucaccgacuggagcggcuacagcggguccuucguccagcaccccgagcucacgggccuggacugcauccgccccugcuucuggguggagcugguccggggccucccgcgcgagaacaccaccaucuggaccucgggguccagcaucuccuucugcggcgugaacagcgacacggccaacugguccuggcccgacggggccgagcugcccuucaccaucgacaaguga

SEQ ID NO: 20445 - RNA, 1413 nt, Artificial Sequence
  derived and/or modified CDS sequence (AUadapt) from InfluenzaA__ADC45804__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaagaucaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccgaggacggcgagggguccugcaacccggucaccguggacggcgcgaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 20446 - RNA, 1413 nt, Artificial Sequence
  derived and/or modified CDS sequence (AUadapt) from InfluenzaA__ADC45815__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccgugaaguccuggaagaagcagauccugcgcacccaggagucggagugcgugugcaugaacggguccugcuucaccaucaugacggacggccccagcaacaaggccgccuccuacaagaucuucaagaucgagaaggggaaggucaccaagagcaucgagcucaacgcccccaacuucuacuacgaggagugcuccugcuacccggacaccggcauggugaugugcgugugccgggacaacuggcacgggucgaaccgccccugggucuccuucaaccagaaccuggacuaccagaucggcuacaucugcagcggcguguucggggacaacccccggcccgaggacggcgagggguccugcaacccggugaccgucgacggcgcgaacggggugaagggcuucagcuacaaguacggcaacgggguguggaucggccgcacgaaguccaaccggcugcgcaagggguucgagaugaucugggaccccaacggcuggaccaacaccgacucggacuucuccgucaagcaggacgugguggccaucaccgacuggagcggguacagcggcuccuucguccagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 20447 - RNA, 1413 nt, Artificial Sequence; identical to SEQ ID NO: 19863
  derived and/or modified CDS sequence (AUadapt) from InfluenzaA__ADC45837__NA

SEQ ID NO: 20448 - RNA, 1413 nt, Artificial Sequence; identical to SEQ ID NO: 19863
  derived and/or modified CDS sequence (AUadapt) from InfluenzaA__ADC45848__NA

SEQ ID NO: 20449 - RNA, 1410 nt, Artificial Sequence; identical to SEQ ID NO: 16318
  derived and/or modified CDS sequence (AUadapt) from InfluenzaA__ADC53559__NA

SEQ ID NO: 20450 - RNA, 1410 nt, Artificial Sequence; identical to SEQ ID NO: 16318
  derived and/or modified CDS sequence (AUadapt) from InfluenzaA__ADD14088__NA

SEQ ID NO: 20451 - RNA, 1410 nt, Artificial Sequence; identical to SEQ ID NO: 16318
  derived and/or modified CDS sequence (AUadapt) from InfluenzaA__ADD14090__NA

SEQ ID NO: 20452 - RNA, 1410 nt, Artificial Sequence; identical to SEQ ID NO: 16318
  derived and/or modified CDS sequence (AUadapt) from InfluenzaA__ADD14094__NA

SEQ ID NO: 20453 - RNA, 1410 nt, Artificial Sequence; identical to SEQ ID NO: 16318
  derived and/or modified CDS sequence (AUadapt) from InfluenzaA__ADD14096__NA

SEQ ID NO: 20454 - RNA, 1410 nt, Artificial Sequence; identical to SEQ ID NO: 16318
  derived and/or modified CDS sequence (AUadapt) from InfluenzaA__ADD14098__NA

SEQ ID NO: 20455 - RNA, 1410 nt, Artificial Sequence; identical to SEQ ID NO: 16318
  derived and/or modified CDS sequence (AUadapt) from InfluenzaA__ADD14100__NA

SEQ ID NO: 20456 - RNA, 1410 nt, Artificial Sequence; identical to SEQ ID NO: 16318
  derived and/or modified CDS sequence (AUadapt) from InfluenzaA__ADD14102__NA

SEQ ID NO: 20457 - RNA, 1410 nt, Artificial Sequence; identical to SEQ ID NO: 16318
  derived and/or modified CDS sequence (AUadapt) from InfluenzaA__ADD14104__NA

SEQ ID NO: 20458 - RNA, 1410 nt, Artificial Sequence; identical to SEQ ID NO: 16318
  derived and/or modified CDS sequence (AUadapt) from InfluenzaA__ADD14106__NA

SEQ ID NO: 20459 - RNA, 1410 nt, Artificial Sequence; identical to SEQ ID NO: 16318
  derived and/or modified CDS sequence (AUadapt) from InfluenzaA__ADD14110__NA

SEQ ID NO: 20460 - RNA, 1410 nt, Artificial Sequence; identical to SEQ ID NO: 16318
  derived and/or modified CDS sequence (AUadapt) from InfluenzaA__ADD14112__NA

SEQ ID NO: 20461 - RNA, 1410 nt, Artificial Sequence; identical to SEQ ID NO: 20110
  derived and/or modified CDS sequence (AUadapt) from InfluenzaA__ADD14114__NA

SEQ ID NO: 20462 - RNA, 1410 nt, Artificial Sequence; identical to SEQ ID NO: 16318
  derived and/or modified CDS sequence (AUadapt) from InfluenzaA__ADD14116__NA

SEQ ID NO: 20463 - RNA, 1410 nt, Artificial Sequence; identical to SEQ ID NO: 16318
  derived and/or modified CDS sequence (AUadapt) from InfluenzaA__ADD14118__NA

SEQ ID NO: 20464 - RNA, 1410 nt, Artificial Sequence; identical to SEQ ID NO: 16318
  derived and/or modified CDS sequence (AUadapt) from InfluenzaA__ADD14120__NA

SEQ ID NO: 20465 - RNA, 1410 nt, Artificial Sequence; identical to SEQ ID NO: 16318
  derived and/or modified CDS sequence (AUadapt) from InfluenzaA__ADD14122__NA

SEQ ID NO: 20466 - RNA, 1410 nt, Artificial Sequence; identical to SEQ ID NO: 16318
  derived and/or modified CDS sequence (AUadapt) from InfluenzaA__ADD14124__NA

SEQ ID NO: 20467 - RNA, 1410 nt, Artificial Sequence; identical to SEQ ID NO: 20199
  derived and/or modified CDS sequence (AUadapt) from InfluenzaA__ADD14126__NA

SEQ ID NO: 20468 - RNA, 1410 nt, Artificial Sequence; identical to SEQ ID NO: 16318
  derived and/or modified CDS sequence (AUadapt) from InfluenzaA__ADD14128__NA

SEQ ID NO: 20469 - RNA, 1410 nt, Artificial Sequence; identical to SEQ ID NO: 16318
  derived and/or modified CDS sequence (AUadapt) from InfluenzaA__ADD14130__NA

SEQ ID NO: 20470 - RNA, 1410 nt, Artificial Sequence; identical to SEQ ID NO: 16318
  derived and/or modified CDS sequence (AUadapt) from InfluenzaA__ADD14132__NA

SEQ ID NO: 20471 - RNA, 1410 nt, Artificial Sequence; identical to SEQ ID NO: 16318
  derived and/or modified CDS sequence (AUadapt) from InfluenzaA__ADD14134__NA

SEQ ID NO: 20472 - RNA, 1410 nt, Artificial Sequence; identical to SEQ ID NO: 16318
  derived and/or modified CDS sequence (AUadapt) from InfluenzaA__ADD14136__NA

SEQ ID NO: 20473 - RNA, 1410 nt, Artificial Sequence; identical to SEQ ID NO: 16318
  derived and/or modified CDS sequence (AUadapt) from InfluenzaA__ADD14138__NA

SEQ ID NO: 20474 - RNA, 1410 nt, Artificial Sequence; identical to SEQ ID NO: 16318
  derived and/or modified CDS sequence (AUadapt) from InfluenzaA__ADD14142__NA

SEQ ID NO: 20475 - RNA, 1410 nt, Artificial Sequence; identical to SEQ ID NO: 16318
  derived and/or modified CDS sequence (AUadapt) from InfluenzaA__ADD14144__NA

SEQ ID NO: 20476 - RNA, 1410 nt, Artificial Sequence; identical to SEQ ID NO: 16318
  derived and/or modified CDS sequence (AUadapt) from InfluenzaA__ADD14146__NA

SEQ ID NO: 20477 - RNA, 1410 nt, Artificial Sequence; identical to SEQ ID NO: 16318
  derived and/or modified CDS sequence (AUadapt) from InfluenzaA__ADD14148__NA

SEQ ID NO: 20478 - RNA, 1410 nt, Artificial Sequence
  derived and/or modified CDS sequence (AUadapt) from InfluenzaA__ADD14150__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacgacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20479 - RNA, 1410 nt, Artificial Sequence; identical to SEQ ID NO: 16318
  derived and/or modified CDS sequence (AUadapt) from InfluenzaA__ADD14152__NA

SEQ ID NO: 20480 - RNA, 1410 nt, Artificial Sequence
  derived and/or modified CDS sequence (AUadapt) from InfluenzaA__ADD14154__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaucacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20481 - RNA, 1410 nt, Artificial Sequence; identical to SEQ ID NO: 16318
  derived and/or modified CDS sequence (AUadapt) from InfluenzaA__ADD14156__NA

SEQ ID NO: 20482 - RNA, 1410 nt, Artificial Sequence; identical to SEQ ID NO: 16318
  derived and/or modified CDS sequence (AUadapt) from InfluenzaA__ADD14158__NA

SEQ ID NO: 20483 - RNA, 1410 nt, Artificial Sequence; identical to SEQ ID NO: 16318
  derived and/or modified CDS sequence (AUadapt) from InfluenzaA__ADD14164__NA

SEQ ID NO: 20484 - RNA, 1410 nt, Artificial Sequence; identical to SEQ ID NO: 16318
  derived and/or modified CDS sequence (AUadapt) from InfluenzaA__ADD14174__NA

SEQ ID NO: 20485 - RNA, 1410 nt, Artificial Sequence; identical to SEQ ID NO: 16318
  derived and/or modified CDS sequence (AUadapt) from InfluenzaA__ADD14184__NA

SEQ ID NO: 20486 - RNA, 1410 nt, Artificial Sequence; identical to SEQ ID NO: 16318
  derived and/or modified CDS sequence (AUadapt) from InfluenzaA__ADD14194__NA

SEQ ID NO: 20487 - RNA, 1410 nt, Artificial Sequence; identical to SEQ ID NO: 19494
  derived and/or modified CDS sequence (AUadapt) from InfluenzaA__ADD14204__NA

SEQ ID NO: 20488 - RNA, 1410 nt, Artificial Sequence
  derived and/or modified CDS sequence (AUadapt) from InfluenzaA__ADD21449__NA
augaaccccaaccagcgcaucaucaccaucggcaccgccugccugaucaucgggaucgugucgcuccugcugcagaucggcaacaucgucucccucuggaucagccacuccauccagacgggggagaagaaccacucggagaccugcaaccggaacaccaucaccuacgagaacuccacgugggugaaccagaccuacgugaacaucagcaacaucaacaucgccggcgggcagggcgucgcguccaucauccuggccggcaacagcucccugugcccggugaacgggugggccaucuacucgaaggacaacuccauccgcaucggcagcaagggggacaucuucgugauccgggagcccuucaucuccugcagccaccucgagugccgcaccuucuuccugacccagggcgcccugcucaacgaccggcacuccaacgggacggucaaggaccgcucgcccuaccggacccugauguccugccccaucggcgaggccccgagccccuacaacuccaaguucgagagcguggcguggucggccuccgccugccacgacggcaugggguggcugaccaucggcaucagcgggcccgacaacggcgccguggcgguccucaaguacaacggcaucaucaccgacacgaucaaguccuggcgcaaccggauccugcgcacccaggagagcgagugcgugugcaucaacggguccugcuucaccaucaugaccgacggccccucgaacgggcaggccuccuacaagaucuucaagauggagcggggcaagaucaucaagagcguggagcuggacgccccgaacuaccacuacgaggagugcuccugcuaccccgacacggggaaggucgugugcgugugccgcgacaacuggcacgccucgaaccggcccugggucuccuucgaccagaaccucgacuaccagaucggcuacaucagcuccggcguguucggggacaacccccgcagcaacgacggcaaggggaacugcggcccggugcuguccaacggggccaacggcgucaagggccugucguuccgguacgggaacggcguguggaucgggcgcaccaaguccaccaacagccgguccggcuucgagaugaucugggaccccaacggguggaccgagacggacagcaacuucucgaugaagcaggacaucaucgcgcucaccgacugguccggcuacagcggcuccuucgugcagcaccccgagcugaccgggaugaacugcauccgccccugcuucugggucgagcugauccggggccagccgaagcagagcaccaucuggacguccgggucguccaucagcuucugcggcguggacuccgagaccgccagcugguccuggcccgacggcgccgaccuccccuucaccaucgacaaguga

SEQ ID NO: 20489 - RNA, 1413 nt, Artificial Sequence
  derived and/or modified CDS sequence (AUadapt) from InfluenzaA__ADD21469__NA
augaaccccaaccagaagaucaucaccaucggcucgaucuccaucgccaucgggaucaucagccugaugcuccagaucggcaacaucaucuccgugugggccucgcacuccauccagaccgggagccagaaccacacgggcaucugcaaccagcgcaucaucaccuacgagaacuccaccugggucaaccacaccuacgugaacaucaacaacacgaacguggucgcggggaaggacaagaccucggugacccuggccggcaacuccagccugugcuccaucagcggcugggccaucuacaccaaggacaacuccauccggaucgggucgaagggcgacguguucgucauccgcgagccguucaucuccugcagccaccucgagugccggacguucuuccugacccagggggcccugcucaacgacaagcacuccaacggcaccgugaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcggucgccgugcugaaguacaacggcaucaucacggagaccaucaaguccuggaagaagcgcaugcugcggacccaggagucggagugcaucugcgugaacggcuccugcuucaccaucaugacggacgggcccagcaacggcgccgccuccuacaagaucuucaagaucgagaaggggaaggucaccaagucgaucgagcucaacgcccccaacuuccacuacgaggagugcuccugcuacccggacaccggcaccgugaugugcgugugccgcgacaacuggcacgggagcaaccggcccugggucuccuucaaccagaaccuggacuaccagaucggcuacaucugcucgggcguguucggggacaacccccgccccaaggacggcgagggguccugcaacccggugacggucgacggcgcggacggggugaagggcuucagcuacaaguacggcaacgggguguggaucggccggaccaaguccaaccgccugcggaagggguucgagaugaucugggaccccaacggcuggaccgacaccgacagcaacuucuccgucaagcaggacgugguggccaucacggacuggucgggguacagcggcuccuucguccagcaccccgagcucaccggccuggacugcauccgccccugcuucuggguggagcugguccgggggcucccgcgcgagaacaccaccaucuggacgucgggcuccagcaucuccuucugcggggugaacagcgacaccgccaacugguccuggcccgacggcgccgagcugcccuucaccaucgacaaguga

SEQ ID NO: 20490 - RNA, 1410 nt, Artificial Sequence; identical to SEQ ID NO: 16318
  derived and/or modified CDS sequence (AUadapt) from InfluenzaA__ADD21747__NA

SEQ ID NO: 20491 - RNA, 1410 nt, Artificial Sequence
  derived and/or modified CDS sequence (AUadapt) from InfluenzaA__ADD21767__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20492 - RNA, 1410 nt, Artificial Sequence
  derived and/or modified CDS sequence (AUadapt) from InfluenzaA__ADD21777__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccgucaucaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 20493 - RNA, 1410 nt, Artificial Sequence; identical to SEQ ID NO: 16318
  derived and/or modified CDS sequence (AUadapt) from InfluenzaA__ADD21787__NA

SEQ ID NO: 20494 - RNA, 1410 nt, Artificial Sequence; identical to SEQ ID NO: 16318
  derived and/or modified CDS sequence (AUadapt) from InfluenzaA__ADD21797__NA

SEQ ID NO: 20495 - RNA, 1410 nt, Artificial Sequence; identical to SEQ ID NO: 16318
  derived and/or modified CDS sequence (AUadapt) from InfluenzaA__ADD21817__NA

SEQ ID NO: 20496 - RNA, 1410 nt, Artificial Sequence; identical to SEQ ID NO: 16318
  derived and/or modified CDS sequence (AUadapt) from InfluenzaA__ADD21827__NA

SEQ ID NO: 20497 - RNA, 1410 nt, Artificial Sequence; identical to SEQ ID NO: 16318
  derived and/or modified CDS sequence (AUadapt) from InfluenzaA__ADD21837__NA

SEQ ID NO: 20498 - RNA, 1410 nt, Artificial Sequence; identical to SEQ ID NO: 16318
  derived and/or modified CDS sequence (AUadapt) from InfluenzaA__ADD21847__NA

SEQ ID NO: 20499 - RNA, 1410 nt, Artificial Sequence; identical to SEQ ID NO: 16318
  derived and/or modified CDS sequence (AUadapt) from InfluenzaA__ADD21857__NA

SEQ ID NO: 20500 - RNA, 1410 nt, Artificial Sequence; identical to SEQ ID NO: 16318
  derived and/or modified CDS sequence (AUadapt) from InfluenzaA__ADD21867__NA

SEQ ID NO: 20501 - RNA, 1410 nt, Artificial Sequence; identical to SEQ ID NO: 16318
  derived and/or modified CDS sequence (AUadapt) from InfluenzaA__ADD21877__NA

SEQ ID NO: 20502 - RNA, 1410 nt, Artificial Sequence; identical to SEQ ID NO: 16318
  derived and/or modified CDS sequence (AUadapt) from InfluenzaA__ADD21897__NA

SEQ ID NO: 20503 - RNA, 1410 nt, Artificial Sequence; identical to SEQ ID NO: 16318
  derived and/or modified CDS sequence (AUadapt) from InfluenzaA__ADD22494__NA

SEQ ID NO: 20504 - RNA, 1410 nt, Artificial Sequence; identical to SEQ ID NO: 16318
  derived and/or modified CDS sequence (AUadapt) from InfluenzaA__ADD22504__NA

SEQ ID NO: 20505 - RNA, 1410 nt, Artificial Sequence; identical to SEQ ID NO: 16318
  derived and/or modified CDS sequence (AUadapt) from InfluenzaA__ADD22514__NA

SEQ ID NO: 20506 - RNA, 1410 nt, Artificial Sequence; identical to SEQ ID NO: 16318
  derived and/or modified CDS sequence (AUadapt) from InfluenzaA__ADD22524__NA

SEQ ID NO: 20507 - RNA, 1410 nt, Artificial Sequence
  derived and/or modified CDS sequence (AUadapt) from InfluenzaA__ADD22534__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacucgccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20508 - RNA, 1410 nt, Artificial Sequence; identical to SEQ ID NO: 16318
  derived and/or modified CDS sequence (AUadapt) from InfluenzaA__ADD22544__NA

SEQ ID NO: 20509 - RNA, 1410 nt, Artificial Sequence; identical to SEQ ID NO: 16318
  derived and/or modified CDS sequence (AUadapt) from InfluenzaA__ADD22557__NA

SEQ ID NO: 20510 - RNA, 1410 nt, Artificial Sequence; identical to SEQ ID NO: 16318
  derived and/or modified CDS sequence (AUadapt) from InfluenzaA__ADD22567__NA

SEQ ID NO: 20511 - RNA, 1410 nt, Artificial Sequence; identical to SEQ ID NO: 16318
  derived and/or modified CDS sequence (AUadapt) from InfluenzaA__ADD22577__NA

SEQ ID NO: 20512 - RNA, 1410 nt, Artificial Sequence; identical to SEQ ID NO: 16318
  derived and/or modified CDS sequence (AUadapt) from InfluenzaA__ADD22587__NA

SEQ ID NO: 20513 - RNA, 1410 nt, Artificial Sequence; identical to SEQ ID NO: 16318
  derived and/or modified CDS sequence (AUadapt) from InfluenzaA__ADD22597__NA

SEQ ID NO: 20514 - RNA, 1410 nt, Artificial Sequence; identical to SEQ ID NO: 16318
  derived and/or modified CDS sequence (AUadapt) from InfluenzaA__ADD22617__NA

SEQ ID NO: 20515 - RNA, 1410 nt, Artificial Sequence; identical to SEQ ID NO: 16318
  derived and/or modified CDS sequence (AUadapt) from InfluenzaA__ADD22627__NA

SEQ ID NO: 20516 - RNA, 1410 nt, Artificial Sequence; identical to SEQ ID NO: 16318
  derived and/or modified CDS sequence (AUadapt) from InfluenzaA__ADD22637__NA

SEQ ID NO: 20517 - RNA, 1410 nt, Artificial Sequence; identical to SEQ ID NO: 16318
  derived and/or modified CDS sequence (AUadapt) from InfluenzaA__ADD22648__NA

SEQ ID NO: 20518 - RNA, 1410 nt, Artificial Sequence; identical to SEQ ID NO: 16318
  derived and/or modified CDS sequence (AUadapt) from InfluenzaA__ADD22658__NA

SEQ ID NO: 20519 - RNA, 1410 nt, Artificial Sequence; identical to SEQ ID NO: 16318
  derived and/or modified CDS sequence (AUadapt) from InfluenzaA__ADD22668__NA

SEQ ID NO: 20520 - RNA, 1410 nt, Artificial Sequence
  derived and/or modified CDS sequence (AUadapt) from InfluenzaA__ADD22688__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucuggaucgagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20521 - RNA, 1410 nt, Artificial Sequence; identical to SEQ ID NO: 16318
  derived and/or modified CDS sequence (AUadapt) from InfluenzaA__ADD22698__NA

SEQ ID NO: 20522 - RNA, 1410 nt, Artificial Sequence; identical to SEQ ID NO: 16318
  derived and/or modified CDS sequence (AUadapt) from InfluenzaA__ADD22725__NA

SEQ ID NO: 20523 - RNA, 1410 nt, Artificial Sequence; identical to SEQ ID NO: 16318
  derived and/or modified CDS sequence (AUadapt) from InfluenzaA__ADD22735__NA

SEQ ID NO: 20524 - RNA, 1410 nt, Artificial Sequence; identical to SEQ ID NO: 16318
  derived and/or modified CDS sequence (AUadapt) from InfluenzaA__ADD22745__NA

SEQ ID NO: 20525 - RNA, 1410 nt, Artificial Sequence
  derived and/or modified CDS sequence (AUadapt) from InfluenzaA__ADD22755__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcaccgucagcggcugggccaucuacuccaaggacaacagcauccgcaucggcuccaagggggacguguucgugauccgggagccguucaucagcugcagcccccuggagugccgcaccuucuuccugacccagggcgcccuccugaacgacaagcacuccaacgggacgaucaaggaccggucccccuaccgcacccugaugucgugccccaucggcgaggucccgucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggucgugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacucgccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcacggacaacaacuucuccaucaagcaggacaucguggggaucaacgaguggucgggcuacuccgggagcuucgugcagcaccccgagcugaccggccuggacugcauccgcccgugcuucugggucgagcucauccggggccgccccaaggagaacaccaucuggaccuccgggagcuccaucagcuucugcggcgugaacuccgacacggucggguggagcuggcccgacggcgccgagcugcccuucaccaucgacaaguga

SEQ ID NO: 20526 - RNA, 1410 nt, Artificial Sequence
  derived and/or modified CDS sequence (AUadapt) from InfluenzaA__ADD22765__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgacugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20527 - RNA, 1410 nt, Artificial Sequence; identical to SEQ ID NO: 16318
  derived and/or modified CDS sequence (AUadapt) from InfluenzaA__ADD22775__NA

SEQ ID NO: 20528 - RNA, 1410 nt, Artificial Sequence; identical to SEQ ID NO: 16318
  derived and/or modified CDS sequence (AUadapt) from InfluenzaA__ADD22785__NA

SEQ ID NO: 20529 - RNA, 1410 nt, Artificial Sequence; identical to SEQ ID NO: 16318
  derived and/or modified CDS sequence (AUadapt) from InfluenzaA__ADD22795__NA

SEQ ID NO: 20530 - RNA, 1410 nt, Artificial Sequence; identical to SEQ ID NO: 16318
  derived and/or modified CDS sequence (AUadapt) from InfluenzaA__ADD22805__NA

SEQ ID NO: 20531 - RNA, 1410 nt, Artificial Sequence; identical to SEQ ID NO: 16318
  derived and/or modified CDS sequence (AUadapt) from InfluenzaA__ADD22815__NA

SEQ ID NO: 20532 - RNA, 1410 nt, Artificial Sequence; identical to SEQ ID NO: 16318
  derived and/or modified CDS sequence (AUadapt) from InfluenzaA__ADD22825__NA

SEQ ID NO: 20533 - RNA, 1410 nt, Artificial Sequence; identical to SEQ ID NO: 16318
  derived and/or modified CDS sequence (AUadapt) from InfluenzaA__ADD22835__NA

SEQ ID NO: 20534 - RNA, 1410 nt, Artificial Sequence; identical to SEQ ID NO: 16318
  derived and/or modified CDS sequence (AUadapt) from InfluenzaA__ADD22845__NA

SEQ ID NO: 20535 - RNA, 1410 nt, Artificial Sequence; identical to SEQ ID NO: 16318
  derived and/or modified CDS sequence (AUadapt) from InfluenzaA__ADD22855__NA

SEQ ID NO: 20536 - RNA, 1410 nt, Artificial Sequence; identical to SEQ ID NO: 16318
  derived and/or modified CDS sequence (AUadapt) from InfluenzaA__ADD22924__NA

SEQ ID NO: 20537 - RNA, 1410 nt, Artificial Sequence; identical to SEQ ID NO: 16318
  derived and/or modified CDS sequence (AUadapt) from InfluenzaA__ADD22934__NA

SEQ ID NO: 20538 - RNA, 1410 nt, Artificial Sequence; identical to SEQ ID NO: 16318
  derived and/or modified CDS sequence (AUadapt) from InfluenzaA__ADD22944__NA

SEQ ID NO: 20539 - RNA, 1410 nt, Artificial Sequence; identical to SEQ ID NO: 16318
  derived and/or modified CDS sequence (AUadapt) from InfluenzaA__ADD22954__NA

SEQ ID NO: 20540 - RNA, 1410 nt, Artificial Sequence; identical to SEQ ID NO: 16318
  derived and/or modified CDS sequence (AUadapt) from InfluenzaA__ADD22974__NA

SEQ ID NO: 20541 - RNA, 1410 nt, Artificial Sequence; identical to SEQ ID NO: 16318
  derived and/or modified CDS sequence (AUadapt) from InfluenzaA__ADD23075__NA

SEQ ID NO: 20542 - RNA, 1410 nt, Artificial Sequence
  derived and/or modified CDS sequence (AUadapt) from InfluenzaA__ADD23085__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcuguucaucagcugcagcccccuggagugccgcaccuucuuccucacccagggcgcccugcugaacgacaagcacuccaacgggaccaucaaggaccggucccccuaccgcacgcucaugagcugccccaucggcgaggucccgucccccuacaacagccgguucgagucgguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccucgacugcauccgcccgugcuucugggucgagcugauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 20543 - RNA, 1410 nt, Artificial Sequence; identical to SEQ ID NO: 16318
  derived and/or modified CDS sequence (AUadapt) from InfluenzaA__ADD23095__NA

SEQ ID NO: 20544 - RNA, 1410 nt, Artificial Sequence; identical to SEQ ID NO: 16318
  derived and/or modified CDS sequence (AUadapt) from InfluenzaA__ADD23105__NA

SEQ ID NO: 20545 - RNA, 1410 nt, Artificial Sequence; identical to SEQ ID NO: 16318
  derived and/or modified CDS sequence (AUadapt) from InfluenzaA__ADD23115__NA

SEQ ID NO: 20546 - RNA, 1410 nt, Artificial Sequence; identical to SEQ ID NO: 16318
  derived and/or modified CDS sequence (AUadapt) from InfluenzaA__ADD23125__NA

SEQ ID NO: 20547 - RNA, 1410 nt, Artificial Sequence; identical to SEQ ID NO: 16318
  derived and/or modified CDS sequence (AUadapt) from InfluenzaA__ADD23135__NA

SEQ ID NO: 20548 - RNA, 1410 nt, Artificial Sequence; identical to SEQ ID NO: 16318
  derived and/or modified CDS sequence (AUadapt) from InfluenzaA__ADD23145__NA

SEQ ID NO: 20549 - RNA, 1410 nt, Artificial Sequence; identical to SEQ ID NO: 16318
  derived and/or modified CDS sequence (AUadapt) from InfluenzaA__ADD23155__NA

SEQ ID NO: 20550 - RNA, 1410 nt, Artificial Sequence; identical to SEQ ID NO: 16318
  derived and/or modified CDS sequence (AUadapt) from InfluenzaA__ADD23165__NA

SEQ ID NO: 20551 - RNA, 1410 nt, Artificial Sequence; identical to SEQ ID NO: 16318
  derived and/or modified CDS sequence (AUadapt) from InfluenzaA__ADD23175__NA

SEQ ID NO: 20552 - RNA, 1410 nt, Artificial Sequence; identical to SEQ ID NO: 16318
  derived and/or modified CDS sequence (AUadapt) from InfluenzaA__ADD23185__NA

SEQ ID NO: 20553 - RNA, 1410 nt, Artificial Sequence; identical to SEQ ID NO: 16318
  derived and/or modified CDS sequence (AUadapt) from InfluenzaA__ADD23195__NA

SEQ ID NO: 20554 - RNA, 1410 nt, Artificial Sequence; identical to SEQ ID NO: 16318
  derived and/or modified CDS sequence (AUadapt) from InfluenzaA__ADD23223__NA

SEQ ID NO: 20555 - RNA, 1410 nt, Artificial Sequence
  derived and/or modified CDS sequence (AUadapt) from InfluenzaA__ADD23233__NA
augaaccccaaccagaagaucaucaccaucggcucggugugcaugaccaucgggauggccaaccugauccuccagaucggcaacaucaucuccaucuggaucgggcacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccggcugggccaucuacagcaaggacaacuccauccgcaucgggagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacucccgguucgagagcguggccuggagcgcguccgccugccacgacggcaucaacuggcucaccaucggcaucucggggcccgacaacggcgccguggccguccugaaguacaacgggaucaucaccgacaccaucaaguccuggcgcaacaacauccugcggacgcaggagagcgagugcgcgugcgugaacggcuccugcuucaccgugaugaccgacggcccgagcgacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucucguucaaguacgggaacggcgucuggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 20556 - RNA, 1410 nt, Artificial Sequence; identical to SEQ ID NO: 16318
  derived and/or modified CDS sequence (AUadapt) from InfluenzaA__ADD23243__NA

SEQ ID NO: 20557 - RNA, 1410 nt, Artificial Sequence; identical to SEQ ID NO: 20428
  derived and/or modified CDS sequence (AUadapt) from InfluenzaA__ADD23253__NA

SEQ ID NO: 20558 - RNA, 1410 nt, Artificial Sequence
  derived and/or modified CDS sequence (AUadapt) from InfluenzaA__ADD23273__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccgagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20559 - RNA, 1410 nt, Artificial Sequence; identical to SEQ ID NO: 16318
  derived and/or modified CDS sequence (AUadapt) from InfluenzaA__ADD23283__NA

SEQ ID NO: 20560 - RNA, 1410 nt, Artificial Sequence; identical to SEQ ID NO: 16318
  derived and/or modified CDS sequence (AUadapt) from InfluenzaA__ADD23293__NA

SEQ ID NO: 20561 - RNA, 1410 nt, Artificial Sequence; identical to SEQ ID NO: 16318
  derived and/or modified CDS sequence (AUadapt) from InfluenzaA__ADD23303__NA

SEQ ID NO: 20562 - RNA, 1410 nt, Artificial Sequence; identical to SEQ ID NO: 16318
  derived and/or modified CDS sequence (AUadapt) from InfluenzaA__ADD23313__NA

SEQ ID NO: 20563 - RNA, 1410 nt, Artificial Sequence
  derived and/or modified CDS sequence (AUadapt) from InfluenzaA__ADD23323__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugcucaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20564 - RNA, 1410 nt, Artificial Sequence; identical to SEQ ID NO: 16318
  derived and/or modified CDS sequence (AUadapt) from InfluenzaA__ADD23333__NA

SEQ ID NO: 20565 - RNA, 1410 nt, Artificial Sequence; identical to SEQ ID NO: 16318
  derived and/or modified CDS sequence (AUadapt) from InfluenzaA__ADD23358__NA

SEQ ID NO: 20566 - RNA, 1410 nt, Artificial Sequence; identical to SEQ ID NO: 20491
  derived and/or modified CDS sequence (AUadapt) from InfluenzaA__ADD23368__NA

SEQ ID NO: 20567 - RNA, 1410 nt, Artificial Sequence; identical to SEQ ID NO: 16318
  derived and/or modified CDS sequence (AUadapt) from InfluenzaA__ADD23378__NA

SEQ ID NO: 20568 - RNA, 1410 nt, Artificial Sequence; identical to SEQ ID NO: 16318
  derived and/or modified CDS sequence (AUadapt) from InfluenzaA__ADD23388__NA

SEQ ID NO: 20569 - RNA, 1410 nt, Artificial Sequence; identical to SEQ ID NO: 19723
  derived and/or modified CDS sequence (AUadapt) from InfluenzaA__ADD23398__NA

SEQ ID NO: 20570 - RNA, 1410 nt, Artificial Sequence
  derived and/or modified CDS sequence (AUadapt) from InfluenzaA__ADD23408__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccaggaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20571 - RNA, 1410 nt, Artificial Sequence
  derived and/or modified CDS sequence (AUadapt) from InfluenzaA__ADD23438__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacagcuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20572 - RNA, 1410 nt, Artificial Sequence; identical to SEQ ID NO: 16318
  derived and/or modified CDS sequence (AUadapt) from InfluenzaA__ADD23448__NA

SEQ ID NO: 20573 - RNA, 1410 nt, Artificial Sequence; identical to SEQ ID NO: 16318
  derived and/or modified CDS sequence (AUadapt) from InfluenzaA__ADD23458__NA

SEQ ID NO: 20574 - RNA, 1410 nt, Artificial Sequence
  derived and/or modified CDS sequence (AUadapt) from InfluenzaA__ADD23468__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucgugggggugaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20575 - RNA, 1410 nt, Artificial Sequence; identical to SEQ ID NO: 16318
  derived and/or modified CDS sequence (AUadapt) from InfluenzaA__ADD23478__NA

SEQ ID NO: 20576 - RNA, 1410 nt, Artificial Sequence; identical to SEQ ID NO: 16318
  derived and/or modified CDS sequence (AUadapt) from InfluenzaA__ADD23488__NA

SEQ ID NO: 20577 - RNA, 1410 nt, Artificial Sequence
  derived and/or modified CDS sequence (AUadapt) from InfluenzaA__ADD23498__NA
augaaccccaaccagaagaucaucaccaucggcucggugugcaugaccaucgggauggccaaccugauccuccagaucggcaacaucaucuccaucuggaucagccacuccauccagcuggggaaccagaaccacaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20578 - RNA, 1410 nt, Artificial Sequence; identical to SEQ ID NO: 16318
  derived and/or modified CDS sequence (AUadapt) from InfluenzaA__ADD23508__NA

SEQ ID NO: 20579 - RNA, 1410 nt, Artificial Sequence; identical to SEQ ID NO: 16318
  derived and/or modified CDS sequence (AUadapt) from InfluenzaA__ADD23518__NA

SEQ ID NO: 20580 - RNA, 1410 nt, Artificial Sequence; identical to SEQ ID NO: 16318
  derived and/or modified CDS sequence (AUadapt) from InfluenzaA__ADD23997__NA

SEQ ID NO: 20581 - RNA, 1410 nt, Artificial Sequence; identical to SEQ ID NO: 16318
  derived and/or modified CDS sequence (AUadapt) from InfluenzaA__ADD24007__NA

SEQ ID NO: 20582 - RNA, 1410 nt, Artificial Sequence; identical to SEQ ID NO: 16318
  derived and/or modified CDS sequence (AUadapt) from InfluenzaA__ADD24017__NA

SEQ ID NO: 20583 - RNA, 1410 nt, Artificial Sequence; identical to SEQ ID NO: 16318
  derived and/or modified CDS sequence (AUadapt) from InfluenzaA__ADD24024__NA

SEQ ID NO: 20584 - RNA, 1410 nt, Artificial Sequence; identical to SEQ ID NO: 16318
  derived and/or modified CDS sequence (AUadapt) from InfluenzaA__ADD24025__NA

SEQ ID NO: 20585 - RNA, 1410 nt, Artificial Sequence; identical to SEQ ID NO: 16318
  derived and/or modified CDS sequence (AUadapt) from InfluenzaA__ADD24026__NA

SEQ ID NO: 20586 - RNA, 1410 nt, Artificial Sequence; identical to SEQ ID NO: 16318
  derived and/or modified CDS sequence (AUadapt) from InfluenzaA__ADD24027__NA

SEQ ID NO: 20587 - RNA, 1410 nt, Artificial Sequence; identical to SEQ ID NO: 16318
  derived and/or modified CDS sequence (AUadapt) from InfluenzaA__ADD24028__NA

SEQ ID NO: 20588 - RNA, 1410 nt, Artificial Sequence; identical to SEQ ID NO: 16318
  derived and/or modified CDS sequence (AUadapt) from InfluenzaA__ADD24029__NA

SEQ ID NO: 20589 - RNA, 1410 nt, Artificial Sequence; identical to SEQ ID NO: 16318
  derived and/or modified CDS sequence (AUadapt) from InfluenzaA__ADD24030__NA

SEQ ID NO: 20590 - RNA, 1410 nt, Artificial Sequence; identical to SEQ ID NO: 16318
  derived and/or modified CDS sequence (AUadapt) from InfluenzaA__ADD24031__NA

SEQ ID NO: 20591 - RNA, 1410 nt, Artificial Sequence; identical to SEQ ID NO: 16318
  derived and/or modified CDS sequence (AUadapt) from InfluenzaA__ADD24032__NA

SEQ ID NO: 20592 - RNA, 1410 nt, Artificial Sequence; identical to SEQ ID NO: 16318
  derived and/or modified CDS sequence (AUadapt) from InfluenzaA__ADD25231__NA

SEQ ID NO: 20593 - RNA, 1410 nt, Artificial Sequence; identical to SEQ ID NO: 16318
  derived and/or modified CDS sequence (AUadapt) from InfluenzaA__ADD25233__NA

SEQ ID NO: 20594 - RNA, 1410 nt, Artificial Sequence; identical to SEQ ID NO: 16318
  derived and/or modified CDS sequence (AUadapt) from InfluenzaA__ADD25235__NA

SEQ ID NO: 20595 - RNA, 1410 nt, Artificial Sequence; identical to SEQ ID NO: 16318
  derived and/or modified CDS sequence (AUadapt) from InfluenzaA__ADD25244__NA

SEQ ID NO: 20596 - RNA, 1410 nt, Artificial Sequence
  derived and/or modified CDS sequence (AUadapt) from InfluenzaA__ADD25246__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaccaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 20597 - RNA, 1410 nt, Artificial Sequence; identical to SEQ ID NO: 16318
  derived and/or modified CDS sequence (AUadapt) from InfluenzaA__ADD25248__NA

SEQ ID NO: 20598 - RNA, 1410 nt, Artificial Sequence
  derived and/or modified CDS sequence (AUadapt) from InfluenzaA__ADD25250__NA
augaaccccaaccagaagaucaucaccaucggcucggugugcaugaccaucgggauggccaaccugauccuccagaucggcaacaucaucuccaucuggaucagccgcuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccggaucggcuccaagggggacgucuucgugauccgcgagcccuucaucagcugcucgccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcgucgccugguccgcgucggccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccgacggccaggccagcuacaagaucuuccggaucgagaaggggaagaucgugaaguccgucgagaugaacgcccccaacuaccacuacgaggagugcucgugcuaccccgacuccggcgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggcuccugcgggcccgucagcuccaacggcgccaacggggugaagggcuucucguucaaguacgggaacggcguguggaucggccggaccaaguccaucagcagccgcaacggguucgagaugaucugggaccccaacggcuggaccgggaccgacaacaacuucuccaucaagcaggacaucgucggcaucaacgaguggagcggguacuccggcucguucgugcagcacccggagcugacgggccuggacugcauccggcccugcuucuggguggagcucauccgcgggcggcccaaggagaacaccaucuggaccuccggcagcuccaucagcuucugcggggucaacuccgacaccaugggcuggagcuggcccgacggcgccgagcugccguucacgaucgacaaguga

SEQ ID NO: 20599 - RNA, 1410 nt, Artificial Sequence; identical to SEQ ID NO: 16318
  derived and/or modified CDS sequence (AUadapt) from InfluenzaA__ADD25255__NA

SEQ ID NO: 20600 - RNA, 1410 nt, Artificial Sequence; identical to SEQ ID NO: 16318
  derived and/or modified CDS sequence (AUadapt) from InfluenzaA__ADD25259__NA

SEQ ID NO: 20601 - RNA, 1410 nt, Artificial Sequence
  derived and/or modified CDS sequence (AUadapt) from InfluenzaA__ADD25262__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaagggcagcugcggccccguguccagcaacggggccgacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20602 - RNA, 1410 nt, Artificial Sequence
  derived and/or modified CDS sequence (AUadapt) from InfluenzaA__ADD25266__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccgggaacuccucgcucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcucaccaucggcaucucgggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 20603 - RNA, 1410 nt, Artificial Sequence; identical to SEQ ID NO: 16318
  derived and/or modified CDS sequence (AUadapt) from InfluenzaA__ADD25268__NA

SEQ ID NO: 20604 - RNA, 1410 nt, Artificial Sequence; identical to SEQ ID NO: 16318
  derived and/or modified CDS sequence (AUadapt) from InfluenzaA__ADD25271__NA

SEQ ID NO: 20605 - RNA, 1410 nt, Artificial Sequence; identical to SEQ ID NO: 16318
  derived and/or modified CDS sequence (AUadapt) from InfluenzaA__ADD25274__NA

SEQ ID NO: 20606 - RNA, 1410 nt, Artificial Sequence; identical to SEQ ID NO: 16318
  derived and/or modified CDS sequence (AUadapt) from InfluenzaA__ADD25276__NA

SEQ ID NO: 20607 - RNA, 1410 nt, Artificial Sequence
  derived and/or modified CDS sequence (AUadapt) from InfluenzaA__ADD25278__NA
augaaccccaaccagaagaucaucaccaucggcucggugugcaugaccaucgggauggccaaccugauccuccagaucggcaacaucaucuccaucuggaucagccgcuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccggaucggcuccaagggggacgucuucgugauccgcgagcccuucaucagcugcucgccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcgucgccugguccgcgucggccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacggcccguccgacggccaggccagcuacaagaucuuccggaucgagaaggggaagaucgugaaguccgucgagaugaacgcccccaacuaccacuacgaggagugcucgugcuaccccgacuccggcgagaucacgugcgugugccgcgacaacuggcacgggagcaaccggcccuggguguccuucaaccagaaccucgaguaccagaucggcuacaucugcagcgggaucuucggcgacaacccgcgccccaacgacaagaccggcuccugcgggcccgucagcuccaacggcgccaacggggugaagggcuucucguucaaguacgggaacggcguguggaucggccggaccaaguccaucagcagccgcaacggguucgagaugaucugggaccccaacggcuggaccgggaccgacaacaacuucuccaucaagcaggacaucgucggcaucaacgaguggagcggguacuccggcucguucgugcagcacccggagcugacgggccuggacugcauccggcccugcuucuggguggagcucauccgcgggcggcccaaggagaacaccaucuggaccuccggcagcuccaucagcuucugcggggucaacuccgacaccgugggcuggagcuggcccgacggcgccgagcugccguucacgaucgacaaguga

SEQ ID NO: 20608 - RNA, 1410 nt, Artificial Sequence; identical to SEQ ID NO: 16318
  derived and/or modified CDS sequence (AUadapt) from InfluenzaA__ADD25280__NA

SEQ ID NO: 20609 - RNA, 1410 nt, Artificial Sequence; identical to SEQ ID NO: 16318
  derived and/or modified CDS sequence (AUadapt) from InfluenzaA__ADD25282__NA

SEQ ID NO: 20610 - RNA, 1410 nt, Artificial Sequence; identical to SEQ ID NO: 20428
  derived and/or modified CDS sequence (AUadapt) from InfluenzaA__ADD25284__NA

SEQ ID NO: 20611 - RNA, 1410 nt, Artificial Sequence; identical to SEQ ID NO: 16318
  derived and/or modified CDS sequence (AUadapt) from InfluenzaA__ADD25287__NA

SEQ ID NO: 20612 - RNA, 1410 nt, Artificial Sequence; identical to SEQ ID NO: 16318
  derived and/or modified CDS sequence (AUadapt) from InfluenzaA__ADD25291__NA

SEQ ID NO: 20613 - RNA, 1410 nt, Artificial Sequence; identical to SEQ ID NO: 20428
  derived and/or modified CDS sequence (AUadapt) from InfluenzaA__ADD25293__NA

SEQ ID NO: 20614 - RNA, 1410 nt, Artificial Sequence; identical to SEQ ID NO: 16318
  derived and/or modified CDS sequence (AUadapt) from InfluenzaA__ADD25300__NA

SEQ ID NO: 20615 - RNA, 1410 nt, Artificial Sequence
  derived and/or modified CDS sequence (AUadapt) from InfluenzaA__ADD25304__NA
augaaccccaaccagaagaucaucaccaucggcucggugugcaugaccaucgggauggccaaccugauccuccagaucggcaacaucgucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20616 - RNA, 1410 nt, Artificial Sequence
  derived and/or modified CDS sequence (AUadapt) from InfluenzaA__ADD25306__NA
augaaccccaaccagaagaucaucaccaucggcucggugugcaugaccaucgggauggccaaccugauccuccagaucggcaacaucaucuccaucuggaucagccgcuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccggaucggcuccaagggggacgucuucgugauccgcgagcccuucaucagcugcucgccccuggagugccggaccuucuuccugacccagggcgcccuccugaacgacaagcacuccaacgggaccaucaaggaccgcucccccuaccggacgcugaugagcugcccgaucggcgaggugcccucccccuacaacagccgcuucgagagcgucgccugguccgcgucggccugccacgacgggaucaacuggcucaccaucggcaucuccggccccgacaacggggccguggccgugcugaaguacaacggcaucaucaccgacaccaucaagagcuggcggaacaacauccugcgcacgcaggaguccgagugcgcgugcgucaacgggagcugcuucaccgugaugaccgacgagccguccgacggccaggccagcuacaagaucuuccggaucgagaagggcaagaucgugaaguccgucgagaugaacgcccccaacuaccacuacgaggagugcucgugcuaccccgacuccggggagaucacgugcgugugccgcgacaacuggcacggcagcaaccggcccuggguguccuucaaccagaaccucgaguaccagaucggguacaucugcagcggcaucuucggggacaacccgcgccccaacgacaagaccggcuccugcggccccgucagcuccaacggggccaacggcgugaagggguucucguucaaguacggcaacgggguguggaucggccggaccaaguccaucagcagccgcaacggcuucgagaugaucugggaccccaacggguggaccggcaccgacaacaacuucuccaucaagcaggacaucgucgggaucaacgaguggagcggcuacuccgggucguucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 20617 - RNA, 1410 nt, Artificial Sequence; identical to SEQ ID NO: 16318
  derived and/or modified CDS sequence (AUadapt) from InfluenzaA__ADD25308__NA

SEQ ID NO: 20618 - RNA, 1410 nt, Artificial Sequence; identical to SEQ ID NO: 16318
  derived and/or modified CDS sequence (AUadapt) from InfluenzaA__ADD25310__NA

SEQ ID NO: 20619 - RNA, 1410 nt, Artificial Sequence; identical to SEQ ID NO: 16318
  derived and/or modified CDS sequence (AUadapt) from InfluenzaA__ADD25312__NA

SEQ ID NO: 20620 - RNA, 1410 nt, Artificial Sequence; identical to SEQ ID NO: 16318
  derived and/or modified CDS sequence (AUadapt) from InfluenzaA__ADD25314__NA

SEQ ID NO: 20621 - RNA, 1410 nt, Artificial Sequence; identical to SEQ ID NO: 16318
  derived and/or modified CDS sequence (AUadapt) from InfluenzaA__ADD25316__NA

SEQ ID NO: 20622 - RNA, 1410 nt, Artificial Sequence; identical to SEQ ID NO: 16318
  derived and/or modified CDS sequence (AUadapt) from InfluenzaA__ADD29799__NA

SEQ ID NO: 20623 - RNA, 1410 nt, Artificial Sequence; identical to SEQ ID NO: 16318
  derived and/or modified CDS sequence (AUadapt) from InfluenzaA__ADD29800__NA

SEQ ID NO: 20624 - RNA, 1410 nt, Artificial Sequence; identical to SEQ ID NO: 16318
  derived and/or modified CDS sequence (AUadapt) from InfluenzaA__ADD29801__NA

SEQ ID NO: 20625 - RNA, 1410 nt, Artificial Sequence; identical to SEQ ID NO: 16318
  derived and/or modified CDS sequence (AUadapt) from InfluenzaA__ADD29802__NA

SEQ ID NO: 20626 - RNA, 1410 nt, Artificial Sequence; identical to SEQ ID NO: 16318
  derived and/or modified CDS sequence (AUadapt) from InfluenzaA__ADD29803__NA

SEQ ID NO: 20627 - RNA, 1410 nt, Artificial Sequence; identical to SEQ ID NO: 16318
  derived and/or modified CDS sequence (AUadapt) from InfluenzaA__ADD29804__NA

SEQ ID NO: 20628 - RNA, 1410 nt, Artificial Sequence; identical to SEQ ID NO: 16318
  derived and/or modified CDS sequence (AUadapt) from InfluenzaA__ADD29805__NA

SEQ ID NO: 20629 - RNA, 1410 nt, Artificial Sequence; identical to SEQ ID NO: 16318
  derived and/or modified CDS sequence (AUadapt) from InfluenzaA__ADD29806__NA

SEQ ID NO: 20630 - RNA, 1410 nt, Artificial Sequence; identical to SEQ ID NO: 16318
  derived and/or modified CDS sequence (AUadapt) from InfluenzaA__ADD29807__NA

SEQ ID NO: 20631 - RNA, 1410 nt, Artificial Sequence; identical to SEQ ID NO: 16318
  derived and/or modified CDS sequence (AUadapt) from InfluenzaA__ADD29808__NA

SEQ ID NO: 20632 - RNA, 1410 nt, Artificial Sequence; identical to SEQ ID NO: 16318
  derived and/or modified CDS sequence (AUadapt) from InfluenzaA__ADD52538__NA

SEQ ID NO: 20633 - RNA, 1410 nt, Artificial Sequence; identical to SEQ ID NO: 20363
  derived and/or modified CDS sequence (AUadapt) from InfluenzaA__ADD74353__NA

SEQ ID NO: 20634 - RNA, 1410 nt, Artificial Sequence; identical to SEQ ID NO: 16318
  derived and/or modified CDS sequence (AUadapt) from InfluenzaA__ADD74373__NA

SEQ ID NO: 20635 - RNA, 1410 nt, Artificial Sequence; identical to SEQ ID NO: 16318
  derived and/or modified CDS sequence (AUadapt) from InfluenzaA__ADD74383__NA

SEQ ID NO: 20636 - RNA, 1410 nt, Artificial Sequence; identical to SEQ ID NO: 16318
  derived and/or modified CDS sequence (AUadapt) from InfluenzaA__ADD74401__NA

SEQ ID NO: 20637 - RNA, 1410 nt, Artificial Sequence
  derived and/or modified CDS sequence (AUadapt) from InfluenzaA__ADD74411__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacgucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcucgugcggccccguguccagcaacggggccaacggcgucaagggguucuccuucaaguacggcagcgggguguggaucggccgcaccaagagcaucuccagccgguccggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20638 - RNA, 1410 nt, Artificial Sequence; identical to SEQ ID NO: 16318
  derived and/or modified CDS sequence (AUadapt) from InfluenzaA__ADD74421__NA

SEQ ID NO: 20639 - RNA, 1410 nt, Artificial Sequence; identical to SEQ ID NO: 16318
  derived and/or modified CDS sequence (AUadapt) from InfluenzaA__ADD74431__NA

SEQ ID NO: 20640 - RNA, 1410 nt, Artificial Sequence
  derived and/or modified CDS sequence (AUadapt) from InfluenzaA__ADD74441__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaucuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20641 - RNA, 1410 nt, Artificial Sequence; identical to SEQ ID NO: 16318
  derived and/or modified CDS sequence (AUadapt) from InfluenzaA__ADD74451__NA

SEQ ID NO: 20642 - RNA, 1410 nt, Artificial Sequence; identical to SEQ ID NO: 16318
  derived and/or modified CDS sequence (AUadapt) from InfluenzaA__ADD74461__NA

SEQ ID NO: 20643 - RNA, 1410 nt, Artificial Sequence; identical to SEQ ID NO: 16318
  derived and/or modified CDS sequence (AUadapt) from InfluenzaA__ADD74471__NA

SEQ ID NO: 20644 - RNA, 1410 nt, Artificial Sequence; identical to SEQ ID NO: 16318
  derived and/or modified CDS sequence (AUadapt) from InfluenzaA__ADD74481__NA

SEQ ID NO: 20645 - RNA, 1410 nt, Artificial Sequence; identical to SEQ ID NO: 20157
  derived and/or modified CDS sequence (AUadapt) from InfluenzaA__ADD74491__NA

SEQ ID NO: 20646 - RNA, 1410 nt, Artificial Sequence; identical to SEQ ID NO: 16318
  derived and/or modified CDS sequence (AUadapt) from InfluenzaA__ADD74501__NA

SEQ ID NO: 20647 - RNA, 1410 nt, Artificial Sequence; identical to SEQ ID NO: 16318
  derived and/or modified CDS sequence (AUadapt) from InfluenzaA__ADD74511__NA

SEQ ID NO: 20648 - RNA, 1410 nt, Artificial Sequence; identical to SEQ ID NO: 20158
  derived and/or modified CDS sequence (AUadapt) from InfluenzaA__ADD74521__NA

SEQ ID NO: 20649 - RNA, 1410 nt, Artificial Sequence; identical to SEQ ID NO: 16318
  derived and/or modified CDS sequence (AUadapt) from InfluenzaA__ADD74531__NA

SEQ ID NO: 20650 - RNA, 1410 nt, Artificial Sequence
  derived and/or modified CDS sequence (AUadapt) from InfluenzaA__ADD74551__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacuacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20651 - RNA, 1410 nt, Artificial Sequence; identical to SEQ ID NO: 16318
  derived and/or modified CDS sequence (AUadapt) from InfluenzaA__ADD74561__NA

SEQ ID NO: 20652 - RNA, 1410 nt, Artificial Sequence; identical to SEQ ID NO: 16318
  derived and/or modified CDS sequence (AUadapt) from InfluenzaA__ADD74571__NA

SEQ ID NO: 20653 - RNA, 1410 nt, Artificial Sequence
  derived and/or modified CDS sequence (AUadapt) from InfluenzaA__ADD74581__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacgccgucgggugguccuggcccgacggcgcggagcugccguucaccaucgacaaguga

SEQ ID NO: 20654 - RNA, 1410 nt, Artificial Sequence; identical to SEQ ID NO: 16318
  derived and/or modified CDS sequence (AUadapt) from InfluenzaA__ADD74591__NA

SEQ ID NO: 20655 - RNA, 1410 nt, Artificial Sequence; identical to SEQ ID NO: 16318
  derived and/or modified CDS sequence (AUadapt) from InfluenzaA__ADD74601__NA

SEQ ID NO: 20656 - RNA, 1410 nt, Artificial Sequence
  derived and/or modified CDS sequence (AUadapt) from InfluenzaA__ADD74611__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcaucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20657 - RNA, 1410 nt, Artificial Sequence; identical to SEQ ID NO: 16318
  derived and/or modified CDS sequence (AUadapt) from InfluenzaA__ADD74621__NA

SEQ ID NO: 20658 - RNA, 1410 nt, Artificial Sequence; identical to SEQ ID NO: 16318
  derived and/or modified CDS sequence (AUadapt) from InfluenzaA__ADD74631__NA

SEQ ID NO: 20659 - RNA, 1410 nt, Artificial Sequence; identical to SEQ ID NO: 16318
  derived and/or modified CDS sequence (AUadapt) from InfluenzaA__ADD74641__NA

SEQ ID NO: 20660 - RNA, 1410 nt, Artificial Sequence; identical to SEQ ID NO: 16318
  derived and/or modified CDS sequence (AUadapt) from InfluenzaA__ADD74651__NA

SEQ ID NO: 20661 - RNA, 1410 nt, Artificial Sequence; identical to SEQ ID NO: 20491
  derived and/or modified CDS sequence (AUadapt) from InfluenzaA__ADD74661__NA

SEQ ID NO: 20662 - RNA, 1410 nt, Artificial Sequence; identical to SEQ ID NO: 16318
  derived and/or modified CDS sequence (AUadapt) from InfluenzaA__ADD74671__NA

SEQ ID NO: 20663 - RNA, 1410 nt, Artificial Sequence; identical to SEQ ID NO: 16318
  derived and/or modified CDS sequence (AUadapt) from InfluenzaA__ADD74681__NA

SEQ ID NO: 20664 - RNA, 1410 nt, Artificial Sequence
  derived and/or modified CDS sequence (AUadapt) from InfluenzaA__ADD74691__NA
augaaccccaaccagaagaucaucaccaucggcucggugugcaugaccaucgggauggccaaccugauccuccagaucggcaacaucaucuccaucuggaucugccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20665 - RNA, 1410 nt, Artificial Sequence; identical to SEQ ID NO: 16318
  derived and/or modified CDS sequence (AUadapt) from InfluenzaA__ADD74701__NA

SEQ ID NO: 20666 - RNA, 1410 nt, Artificial Sequence; identical to SEQ ID NO: 16318
  derived and/or modified CDS sequence (AUadapt) from InfluenzaA__ADD74711__NA

SEQ ID NO: 20667 - RNA, 1410 nt, Artificial Sequence; identical to SEQ ID NO: 16318
  derived and/or modified CDS sequence (AUadapt) from InfluenzaA__ADD74721__NA

SEQ ID NO: 20668 - RNA, 1410 nt, Artificial Sequence; identical to SEQ ID NO: 16318
  derived and/or modified CDS sequence (AUadapt) from InfluenzaA__ADD74731__NA

SEQ ID NO: 20669 - RNA, 1410 nt, Artificial Sequence
  derived and/or modified CDS sequence (AUadapt) from InfluenzaA__ADD74741__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggucguccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 20670 - RNA, 1410 nt, Artificial Sequence
  derived and/or modified CDS sequence (AUadapt) from InfluenzaA__ADD74751__NA
augaaccccaaccagaagaucaucaccaucggcucggugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucaaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaugaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20671 - RNA, 1410 nt, Artificial Sequence
  derived and/or modified CDS sequence (AUadapt) from InfluenzaA__ADD74761__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcaucaacagcgacaccguggggugguccuggcccgacggcgccgagcugccguucacgaucgacaaguga

SEQ ID NO: 20672 - RNA, 1410 nt, Artificial Sequence; identical to SEQ ID NO: 16318
  derived and/or modified CDS sequence (AUadapt) from InfluenzaA__ADD74791__NA

SEQ ID NO: 20673 - RNA, 1410 nt, Artificial Sequence; identical to SEQ ID NO: 19723
  derived and/or modified CDS sequence (AUadapt) from InfluenzaA__ADD74811__NA

SEQ ID NO: 20674 - RNA, 1410 nt, Artificial Sequence; identical to SEQ ID NO: 16318
  derived and/or modified CDS sequence (AUadapt) from InfluenzaA__ADD74821__NA

SEQ ID NO: 20675 - RNA, 1410 nt, Artificial Sequence
  derived and/or modified CDS sequence (AUadapt) from InfluenzaA__ADD74831__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugccucaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccucgacugcauccgccccugcuucuggguggagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20676 - RNA, 1410 nt, Artificial Sequence; identical to SEQ ID NO: 16318
  derived and/or modified CDS sequence (AUadapt) from InfluenzaA__ADD74841__NA

SEQ ID NO: 20677 - RNA, 1410 nt, Artificial Sequence; identical to SEQ ID NO: 16318
  derived and/or modified CDS sequence (AUadapt) from InfluenzaA__ADD74851__NA

SEQ ID NO: 20678 - RNA, 1410 nt, Artificial Sequence; identical to SEQ ID NO: 20247
  derived and/or modified CDS sequence (AUadapt) from InfluenzaA__ADD74861__NA

SEQ ID NO: 20679 - RNA, 1410 nt, Artificial Sequence; identical to SEQ ID NO: 16318
  derived and/or modified CDS sequence (AUadapt) from InfluenzaA__ADD74871__NA

SEQ ID NO: 20680 - RNA, 1410 nt, Artificial Sequence; identical to SEQ ID NO: 16318
  derived and/or modified CDS sequence (AUadapt) from InfluenzaA__ADD74881__NA

SEQ ID NO: 20681 - RNA, 1410 nt, Artificial Sequence; identical to SEQ ID NO: 16318
  derived and/or modified CDS sequence (AUadapt) from InfluenzaA__ADD74891__NA

SEQ ID NO: 20682 - RNA, 1410 nt, Artificial Sequence; identical to SEQ ID NO: 16318
  derived and/or modified CDS sequence (AUadapt) from InfluenzaA__ADD74901__NA

SEQ ID NO: 20683 - RNA, 1410 nt, Artificial Sequence; identical to SEQ ID NO: 16318
  derived and/or modified CDS sequence (AUadapt) from InfluenzaA__ADD74911__NA

SEQ ID NO: 20684 - RNA, 1410 nt, Artificial Sequence; identical to SEQ ID NO: 16318
  derived and/or modified CDS sequence (AUadapt) from InfluenzaA__ADD74921__NA

SEQ ID NO: 20685 - RNA, 1410 nt, Artificial Sequence; identical to SEQ ID NO: 16318
  derived and/or modified CDS sequence (AUadapt) from InfluenzaA__ADD74941__NA

SEQ ID NO: 20686 - RNA, 1410 nt, Artificial Sequence
  derived and/or modified CDS sequence (AUadapt) from InfluenzaA__ADD74961__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccacaccuacgugaacaucuccaacacgaacuucgccgcggggcagagcgucguguccgugaagcuggccggcaacucgucccucugcccggucagcggcugggccaucuacuccaaggacaacagcgugcgcaucggguccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggaggugcccucccccuacaacagccgguucgagagcguggccugguccgcgagcgccugccacgacggcaucaacuggcucaccaucggcaucuccgggcccgacaacggcgccgucgccgugcugaaguacaacgggaucaucaccgacaccaucaagagcuggcgcaacaacauccugcggacgcaggaguccgagugcgcgugcgugaacggcucgugcuucaccgucaugaccgacggcccguccgacgggcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucagcucccggaacggguucgagaugaucugggaccccaacggcuggaccgggaccgacaacaacuucucgaucaagcaggacaucgugggcaucaacgagugguccggguacagcggcuccuucguccagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 20687 - RNA, 1410 nt, Artificial Sequence; identical to SEQ ID NO: 16318
  derived and/or modified CDS sequence (AUadapt) from InfluenzaA__ADD74971__NA

SEQ ID NO: 20688 - RNA, 1410 nt, Artificial Sequence
  derived and/or modified CDS sequence (AUadapt) from InfluenzaA__ADD74981__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggagcggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccgaggagaacaccaucuggaccuccgggagcuccaucagcuucugcggcgucaacuccgacaccgugggguggagcuggcccgacggcgccgagcugccguucacgaucgacaaguga

SEQ ID NO: 20689 - RNA, 1410 nt, Artificial Sequence; identical to SEQ ID NO: 16318
  derived and/or modified CDS sequence (AUadapt) from InfluenzaA__ADD74991__NA

SEQ ID NO: 20690 - RNA, 1410 nt, Artificial Sequence; identical to SEQ ID NO: 16318
  derived and/or modified CDS sequence (AUadapt) from InfluenzaA__ADD75001__NA

SEQ ID NO: 20691 - RNA, 1410 nt, Artificial Sequence
  derived and/or modified CDS sequence (AUadapt) from InfluenzaA__ADD75011__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcgaccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 20692 - RNA, 1410 nt, Artificial Sequence; identical to SEQ ID NO: 20428
  derived and/or modified CDS sequence (AUadapt) from InfluenzaA__ADD75031__NA

SEQ ID NO: 20693 - RNA, 1410 nt, Artificial Sequence
  derived and/or modified CDS sequence (AUadapt) from InfluenzaA__ADD75041__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20694 - RNA, 1410 nt, Artificial Sequence; identical to SEQ ID NO: 16318
  derived and/or modified CDS sequence (AUadapt) from InfluenzaA__ADD75051__NA

SEQ ID NO: 20695 - RNA, 1410 nt, Artificial Sequence; identical to SEQ ID NO: 16318
  derived and/or modified CDS sequence (AUadapt) from InfluenzaA__ADD75061__NA

SEQ ID NO: 20696 - RNA, 1410 nt, Artificial Sequence; identical to SEQ ID NO: 16318
  derived and/or modified CDS sequence (AUadapt) from InfluenzaA__ADD75071__NA

SEQ ID NO: 20697 - RNA, 1410 nt, Artificial Sequence; identical to SEQ ID NO: 16318
  derived and/or modified CDS sequence (AUadapt) from InfluenzaA__ADD75081__NA

SEQ ID NO: 20698 - RNA, 1410 nt, Artificial Sequence
  derived and/or modified CDS sequence (AUadapt) from InfluenzaA__ADD75091__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20699 - RNA, 1410 nt, Artificial Sequence; identical to SEQ ID NO: 16318
  derived and/or modified CDS sequence (AUadapt) from InfluenzaA__ADD75101__NA

SEQ ID NO: 20700 - RNA, 1410 nt, Artificial Sequence; identical to SEQ ID NO: 16318
  derived and/or modified CDS sequence (AUadapt) from InfluenzaA__ADD75111__NA

SEQ ID NO: 20701 - RNA, 1410 nt, Artificial Sequence; identical to SEQ ID NO: 16318
  derived and/or modified CDS sequence (AUadapt) from InfluenzaA__ADD75121__NA

SEQ ID NO: 20702 - RNA, 1410 nt, Artificial Sequence; identical to SEQ ID NO: 16318
  derived and/or modified CDS sequence (AUadapt) from InfluenzaA__ADD75131__NA

SEQ ID NO: 20703 - RNA, 1410 nt, Artificial Sequence; identical to SEQ ID NO: 16318
  derived and/or modified CDS sequence (AUadapt) from InfluenzaA__ADD75141__NA

SEQ ID NO: 20704 - RNA, 1410 nt, Artificial Sequence
  derived and/or modified CDS sequence (AUadapt) from InfluenzaA__ADD75161__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccucguaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguacaagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgaccgguga

SEQ ID NO: 20705 - RNA, 1410 nt, Artificial Sequence
  derived and/or modified CDS sequence (AUadapt) from InfluenzaA__ADD84500__NA
augaaccccaaccagaacaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaucgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20706 - RNA, 1410 nt, Artificial Sequence
  derived and/or modified CDS sequence (AUadapt) from InfluenzaA__ADD84502__NA
augaaccccaaccagaacaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20707 - RNA, 1410 nt, Artificial Sequence; identical to SEQ ID NO: 20706
  derived and/or modified CDS sequence (AUadapt) from InfluenzaA__ADD84503__NA

SEQ ID NO: 20708 - RNA, 1410 nt, Artificial Sequence
  derived and/or modified CDS sequence (AUadapt) from InfluenzaA__ADD84504__NA
augaaccccaaccagaacaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacuucagccucugcccggucuccggcugggccaucuacucgaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20709 - RNA, 1410 nt, Artificial Sequence; identical to SEQ ID NO: 20706
  derived and/or modified CDS sequence (AUadapt) from InfluenzaA__ADD84505__NA

SEQ ID NO: 20710 - RNA, 1410 nt, Artificial Sequence; identical to SEQ ID NO: 20706
  derived and/or modified CDS sequence (AUadapt) from InfluenzaA__ADD84506__NA

SEQ ID NO: 20711 - RNA, 1410 nt, Artificial Sequence
  derived and/or modified CDS sequence (AUadapt) from InfluenzaA__ADD92528__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacucgauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggccacagcggguccucggugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20712 - RNA, 1410 nt, Artificial Sequence; identical to SEQ ID NO: 20363
  derived and/or modified CDS sequence (AUadapt) from InfluenzaA__ADD96769__NA

SEQ ID NO: 20713 - RNA, 1410 nt, Artificial Sequence; identical to SEQ ID NO: 20363
  derived and/or modified CDS sequence (AUadapt) from InfluenzaA__ADD96779__NA

SEQ ID NO: 20714 - RNA, 1410 nt, Artificial Sequence; identical to SEQ ID NO: 20363
  derived and/or modified CDS sequence (AUadapt) from InfluenzaA__ADD96789__NA

SEQ ID NO: 20715 - RNA, 1410 nt, Artificial Sequence; identical to SEQ ID NO: 20491
  derived and/or modified CDS sequence (AUadapt) from InfluenzaA__ADD96799__NA

SEQ ID NO: 20716 - RNA, 1410 nt, Artificial Sequence; identical to SEQ ID NO: 16318
  derived and/or modified CDS sequence (AUadapt) from InfluenzaA__ADD96809__NA

SEQ ID NO: 20717 - RNA, 1410 nt, Artificial Sequence
  derived and/or modified CDS sequence (AUadapt) from InfluenzaA__ADD96819__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggucguccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 20718 - RNA, 1410 nt, Artificial Sequence; identical to SEQ ID NO: 16318
  derived and/or modified CDS sequence (AUadapt) from InfluenzaA__ADD96829__NA

SEQ ID NO: 20719 - RNA, 1410 nt, Artificial Sequence; identical to SEQ ID NO: 16318
  derived and/or modified CDS sequence (AUadapt) from InfluenzaA__ADD96839__NA

SEQ ID NO: 20720 - RNA, 1410 nt, Artificial Sequence; identical to SEQ ID NO: 16318
  derived and/or modified CDS sequence (AUadapt) from InfluenzaA__ADD96849__NA

SEQ ID NO: 20721 - RNA, 1410 nt, Artificial Sequence; identical to SEQ ID NO: 16318
  derived and/or modified CDS sequence (AUadapt) from InfluenzaA__ADD96859__NA

SEQ ID NO: 20722 - RNA, 1410 nt, Artificial Sequence
  derived and/or modified CDS sequence (AUadapt) from InfluenzaA__ADD96869__NA
augaaccccaaccagaagaucaucaccaucggcucggugugcaugaccaucgggauggccaaccugauccuccagaucggcaacaucaucuccaucuggaucagccacccgauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcucaccaucggcaucucgggcccggacaacggggccguggccguccugaaguacaacggcaucaucaccgacaccaucaaguccuggaagaacaacauccugcgcacgcaggagagcgagugcgcgugcgugaacggguccugcuucaccgugaugaccgacggccccagcgacggccaggccuccuacaagaucuuccggaucgagaaggggaagaucgucaagagcguggagaugaacgcccccaacuaccacuacgaggagugcuccugcuaccccgacucguccgagaucacgugcgugugccgcgacaacuggcacggcagcaaccggccgugggucuccuucaaccagaaccucgaguaccagaucggguacaucugcagcggcaucuucggggacaacccccgccccaacgacaagaccggcuccugcggccccgugagcuccaacggggccaacggcgugaagggguucucguucaaguacggcaacggggucuggaucggccggaccaaguccaucagcagccgcaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccggcccugcuucugggucgagcucauccgcggccggcccaaggagaacaccaucuggaccuccgggagcuccaucagcuucugcggcgugaacuccgacaccgucggguggagcuggccggacggcgccgagcugcccuucacgaucgacaaguga

SEQ ID NO: 20723 - RNA, 1410 nt, Artificial Sequence
  derived and/or modified CDS sequence (AUadapt) from InfluenzaA__ADD96879__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccugggcugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucucgaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 20724 - RNA, 1410 nt, Artificial Sequence; identical to SEQ ID NO: 16318
  derived and/or modified CDS sequence (AUadapt) from InfluenzaA__ADD96889__NA

SEQ ID NO: 20725 - RNA, 1410 nt, Artificial Sequence; identical to SEQ ID NO: 19723
  derived and/or modified CDS sequence (AUadapt) from InfluenzaA__ADD96899__NA

SEQ ID NO: 20726 - RNA, 1410 nt, Artificial Sequence; identical to SEQ ID NO: 16318
  derived and/or modified CDS sequence (AUadapt) from InfluenzaA__ADD96909__NA

SEQ ID NO: 20727 - RNA, 1410 nt, Artificial Sequence; identical to SEQ ID NO: 16318
  derived and/or modified CDS sequence (AUadapt) from InfluenzaA__ADD96919__NA

SEQ ID NO: 20728 - RNA, 1410 nt, Artificial Sequence; identical to SEQ ID NO: 16318
  derived and/or modified CDS sequence (AUadapt) from InfluenzaA__ADD96929__NA

SEQ ID NO: 20729 - RNA, 1410 nt, Artificial Sequence; identical to SEQ ID NO: 16318
  derived and/or modified CDS sequence (AUadapt) from InfluenzaA__ADD96939__NA

SEQ ID NO: 20730 - RNA, 1410 nt, Artificial Sequence; identical to SEQ ID NO: 16318
  derived and/or modified CDS sequence (AUadapt) from InfluenzaA__ADD96959__NA

SEQ ID NO: 20731 - RNA, 1410 nt, Artificial Sequence; identical to SEQ ID NO: 16318
  derived and/or modified CDS sequence (AUadapt) from InfluenzaA__ADD96969__NA

SEQ ID NO: 20732 - RNA, 1410 nt, Artificial Sequence
  derived and/or modified CDS sequence (AUadapt) from InfluenzaA__ADD96989__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccgguccucguaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 20733 - RNA, 1410 nt, Artificial Sequence
  derived and/or modified CDS sequence (AUadapt) from InfluenzaA__ADD97038__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaucggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgggggcugguccuggcccgacggcgccgagcugccguucaccaucgacaaguga

SEQ ID NO: 20734 - RNA, 1410 nt, Artificial Sequence; identical to SEQ ID NO: 16318
  derived and/or modified CDS sequence (AUadapt) from InfluenzaA__ADD97048__NA

SEQ ID NO: 20735 - RNA, 1410 nt, Artificial Sequence; identical to SEQ ID NO: 16318
  derived and/or modified CDS sequence (AUadapt) from InfluenzaA__ADD97058__NA

SEQ ID NO: 20736 - RNA, 1410 nt, Artificial Sequence; identical to SEQ ID NO: 16318
  derived and/or modified CDS sequence (AUadapt) from InfluenzaA__ADD97069__NA

SEQ ID NO: 20737 - RNA, 1410 nt, Artificial Sequence; identical to SEQ ID NO: 16318
  derived and/or modified CDS sequence (AUadapt) from InfluenzaA__ADD97126__NA

SEQ ID NO: 20738 - RNA, 1410 nt, Artificial Sequence; identical to SEQ ID NO: 16318
  derived and/or modified CDS sequence (AUadapt) from InfluenzaA__ADD97164__NA

SEQ ID NO: 20739 - RNA, 1410 nt, Artificial Sequence; identical to SEQ ID NO: 16318
  derived and/or modified CDS sequence (AUadapt) from InfluenzaA__ADD97174__NA

SEQ ID NO: 20740 - RNA, 1410 nt, Artificial Sequence; identical to SEQ ID NO: 16318
  derived and/or modified CDS sequence (AUadapt) from InfluenzaA__ADD97184__NA

SEQ ID NO: 20741 - RNA, 1410 nt, Artificial Sequence
  derived and/or modified CDS sequence (AUadapt) from InfluenzaA__ADD97194__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacgccaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 20742 - RNA, 1410 nt, Artificial Sequence; identical to SEQ ID NO: 20732
  derived and/or modified CDS sequence (AUadapt) from InfluenzaA__ADD97204__NA

SEQ ID NO: 20743 - RNA, 1410 nt, Artificial Sequence; identical to SEQ ID NO: 16318
  derived and/or modified CDS sequence (AUadapt) from InfluenzaA__ADD97214__NA

SEQ ID NO: 20744 - RNA, 1410 nt, Artificial Sequence; identical to SEQ ID NO: 16318
  derived and/or modified CDS sequence (AUadapt) from InfluenzaA__ADD97224__NA

SEQ ID NO: 20745 - RNA, 1410 nt, Artificial Sequence; identical to SEQ ID NO: 16318
  derived and/or modified CDS sequence (AUadapt) from InfluenzaA__ADD97234__NA

SEQ ID NO: 20746 - RNA, 1410 nt, Artificial Sequence; identical to SEQ ID NO: 16318
  derived and/or modified CDS sequence (AUadapt) from InfluenzaA__ADD97244__NA

SEQ ID NO: 20747 - RNA, 1410 nt, Artificial Sequence; identical to SEQ ID NO: 16318
  derived and/or modified CDS sequence (AUadapt) from InfluenzaA__ADD97254__NA

SEQ ID NO: 20748 - RNA, 1410 nt, Artificial Sequence; identical to SEQ ID NO: 16318
  derived and/or modified CDS sequence (AUadapt) from InfluenzaA__ADD97264__NA

SEQ ID NO: 20749 - RNA, 1410 nt, Artificial Sequence; identical to SEQ ID NO: 16318
  derived and/or modified CDS sequence (AUadapt) from InfluenzaA__ADD97274__NA

SEQ ID NO: 20750 - RNA, 1410 nt, Artificial Sequence
  derived and/or modified CDS sequence (AUadapt) from InfluenzaA__ADD97284__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucugcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20751 - RNA, 1410 nt, Artificial Sequence; identical to SEQ ID NO: 16318
  derived and/or modified CDS sequence (AUadapt) from InfluenzaA__ADD97294__NA

SEQ ID NO: 20752 - RNA, 1410 nt, Artificial Sequence
  derived and/or modified CDS sequence (AUadapt) from InfluenzaA__ADD97314__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 20753 - RNA, 1410 nt, Artificial Sequence; identical to SEQ ID NO: 16318
  derived and/or modified CDS sequence (AUadapt) from InfluenzaA__ADD97334__NA

SEQ ID NO: 20754 - RNA, 1410 nt, Artificial Sequence; identical to SEQ ID NO: 16318
  derived and/or modified CDS sequence (AUadapt) from InfluenzaA__ADD97344__NA

SEQ ID NO: 20755 - RNA, 1410 nt, Artificial Sequence; identical to SEQ ID NO: 16318
  derived and/or modified CDS sequence (AUadapt) from InfluenzaA__ADD97354__NA

SEQ ID NO: 20756 - RNA, 1410 nt, Artificial Sequence
  derived and/or modified CDS sequence (AUadapt) from InfluenzaA__ADD97384__NA
augaaccccaaccagaagaucaucaccaucggcucggugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggucgcccuaccgcacccugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggucguucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 20757 - RNA, 1410 nt, Artificial Sequence
  derived and/or modified CDS sequence (AUadapt) from InfluenzaA__ADD97394__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagccggucgugucggugaagcuggccgggaacuccagccucugccccgucaacggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccgguccccguaccgcacgcugaugagcugccccaucggcgagguccccucccccuacaacagccgguucgaguccguggccuggagcgcgucggccugccacgacgggaucaacuggcucaccaucggcaucuccggcccggacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaccggcagcugcggccccguguccucgaacggggccaacggcgugaagggguucuccuucaaguacggcaacggggucuggaucggccgcaccaagagcaucuccagccggaacggcuucgagaugaucugggacccgaacggguggaccggcaccgacaacaacuucagcaucaagcaggacaucguggggaucaacgagugguccggcuacucgggguccuucgugcagcaccccgagcugacgggccuggacugcauccgccccugcuucugggucgagcucauccggggccgccccaaggagaacaccaucuggaccagcggguccagcaucuccuucugcggcgugaacagcgacaccgucgggugguccuggccggacggcgccgagcugcccuucacgaucgacaaguga

SEQ ID NO: 20758 - RNA, 1410 nt, Artificial Sequence; identical to SEQ ID NO: 16318
  derived and/or modified CDS sequence (AUadapt) from InfluenzaA__ADD97404__NA

SEQ ID NO: 20759 - RNA, 1410 nt, Artificial Sequence; identical to SEQ ID NO: 16318
  derived and/or modified CDS sequence (AUadapt) from InfluenzaA__ADD97424__NA

SEQ ID NO: 20760 - RNA, 1410 nt, Artificial Sequence; identical to SEQ ID NO: 16318
  derived and/or modified CDS sequence (AUadapt) from InfluenzaA__ADD97434__NA

SEQ ID NO: 20761 - RNA, 1410 nt, Artificial Sequence; identical to SEQ ID NO: 16318
  derived and/or modified CDS sequence (AUadapt) from InfluenzaA__ADD97444__NA

SEQ ID NO: 20762 - RNA, 1410 nt, Artificial Sequence
  derived and/or modified CDS sequence (AUadapt) from InfluenzaA__ADD97454__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccgaucagcggcugggccaucuacuccaaggacaacagcauccgcaucggcuccaagggggacgucuucgugauccgggagcccuucaucagcugcagcccccuggagugccgcaccuucuuccugacccagggcgcccuccugucggacaagcacuccaacgggaccaucaaggaccggagccccuaccgcacgcugauguccugcccgaucggcgaggugcccagccccuacaacagccgguucgaguccgucgccuggagcgcguccgccugccacgacgggaucaacuggcucaccaucggcaucucgggccccgacaacggggccguggccgugcugaaguacaacggcaucaucaccgacaccaucaaguccuggcgcaacaacauccugcggacgcaggagagcgagugcgcgugcgucaacggguccugcuucaccgugaugaccgacggcccgagcgacggccaggccuccuacaagaucuuccgcaucgagaaggggaagaucgugaaguccgucgagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaacggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 20763 - RNA, 1410 nt, Artificial Sequence
  derived and/or modified CDS sequence (AUadapt) from InfluenzaA__ADD97464__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcacgaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 20764 - RNA, 1410 nt, Artificial Sequence; identical to SEQ ID NO: 16318
  derived and/or modified CDS sequence (AUadapt) from InfluenzaA__ADD97474__NA

SEQ ID NO: 20765 - RNA, 1410 nt, Artificial Sequence; identical to SEQ ID NO: 16318
  derived and/or modified CDS sequence (AUadapt) from InfluenzaA__ADD97484__NA

SEQ ID NO: 20766 - RNA, 1410 nt, Artificial Sequence
  derived and/or modified CDS sequence (AUadapt) from InfluenzaA__ADD97494__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucccccucggagugccgcaccuucuuccugacccagggcgcccugcucaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcugaccaucggcaucagcggccccgacaacggggccguggccguccucaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcucacgggccuggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 20767 - RNA, 1410 nt, Artificial Sequence; identical to SEQ ID NO: 16318
  derived and/or modified CDS sequence (AUadapt) from InfluenzaA__ADD97504__NA

SEQ ID NO: 20768 - RNA, 1410 nt, Artificial Sequence; identical to SEQ ID NO: 16318
  derived and/or modified CDS sequence (AUadapt) from InfluenzaA__ADD97514__NA

SEQ ID NO: 20769 - RNA, 1410 nt, Artificial Sequence; identical to SEQ ID NO: 20752
  derived and/or modified CDS sequence (AUadapt) from InfluenzaA__ADD97534__NA

SEQ ID NO: 20770 - RNA, 1410 nt, Artificial Sequence; identical to SEQ ID NO: 16318
  derived and/or modified CDS sequence (AUadapt) from InfluenzaA__ADD97544__NA

SEQ ID NO: 20771 - RNA, 1410 nt, Artificial Sequence; identical to SEQ ID NO: 16318
  derived and/or modified CDS sequence (AUadapt) from InfluenzaA__ADD97554__NA

SEQ ID NO: 20772 - RNA, 1410 nt, Artificial Sequence; identical to SEQ ID NO: 20756
  derived and/or modified CDS sequence (AUadapt) from InfluenzaA__ADD97564__NA

SEQ ID NO: 20773 - RNA, 1410 nt, Artificial Sequence; identical to SEQ ID NO: 16318
  derived and/or modified CDS sequence (AUadapt) from InfluenzaA__ADD97574__NA

SEQ ID NO: 20774 - RNA, 1410 nt, Artificial Sequence; identical to SEQ ID NO: 16318
  derived and/or modified CDS sequence (AUadapt) from InfluenzaA__ADD97584__NA

SEQ ID NO: 20775 - RNA, 1410 nt, Artificial Sequence
  derived and/or modified CDS sequence (AUadapt) from InfluenzaA__ADD97681__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcaucaacagcgacaccguggggugguccuggcccgacggcgccgagcugccguucacgaucgacaaguga

SEQ ID NO: 20776 - RNA, 1410 nt, Artificial Sequence; identical to SEQ ID NO: 20732
  derived and/or modified CDS sequence (AUadapt) from InfluenzaA__ADD97691__NA

SEQ ID NO: 20777 - RNA, 1410 nt, Artificial Sequence; identical to SEQ ID NO: 20277
  derived and/or modified CDS sequence (AUadapt) from InfluenzaA__ADD97701__NA

SEQ ID NO: 20778 - RNA, 1410 nt, Artificial Sequence; identical to SEQ ID NO: 16318
  derived and/or modified CDS sequence (AUadapt) from InfluenzaA__ADD97891__NA

SEQ ID NO: 20779 - RNA, 1410 nt, Artificial Sequence; identical to SEQ ID NO: 16318
  derived and/or modified CDS sequence (AUadapt) from InfluenzaA__ADD97901__NA

SEQ ID NO: 20780 - RNA, 1410 nt, Artificial Sequence; identical to SEQ ID NO: 16318
  derived and/or modified CDS sequence (AUadapt) from InfluenzaA__ADD97911__NA

SEQ ID NO: 20781 - RNA, 1410 nt, Artificial Sequence; identical to SEQ ID NO: 16318
  derived and/or modified CDS sequence (AUadapt) from InfluenzaA__ADD97921__NA

SEQ ID NO: 20782 - RNA, 1410 nt, Artificial Sequence; identical to SEQ ID NO: 16318
  derived and/or modified CDS sequence (AUadapt) from InfluenzaA__ADD97931__NA

SEQ ID NO: 20783 - RNA, 1410 nt, Artificial Sequence; identical to SEQ ID NO: 19907
  derived and/or modified CDS sequence (AUadapt) from InfluenzaA__ADD97941__NA

SEQ ID NO: 20784 - RNA, 1410 nt, Artificial Sequence
  derived and/or modified CDS sequence (AUadapt) from InfluenzaA__ADD97951__NA
augaaccccaaccagaagaucaucaccaucucguccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagucggagugcgcgugcgugaacggcuccugcuucaccgugaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcucggggaucuucggcgacaacccgcggcccaacgacaagaccggguccugcggccccgugagcuccaacggcgccaacggggugaagggcuucagcuucaaguacgggaacggcgucuggaucgggcgcaccaagagcaucuccagccggaacggcuucgagaugaucugggaccccaacggcuggaccgggaccgacaacaacuucuccaucaagcaggacaucgugggcaucaacgaguggucgggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggccgagcugccguucacgaucgacaaguga

SEQ ID NO: 20785 - RNA, 1410 nt, Artificial Sequence
  derived and/or modified CDS sequence (AUadapt) from InfluenzaA__ADD97961__NA
augaaccccaaccagaagaucaucaccaucggcucggugugcaugaccaucgggauggucaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgccggccagagcgugguguccgucaagcuggcggggaacgccucgcucugcccgguguccggcugggccaucuacagcaaggacaacuccauccgcaucggcagcaagggggacguguucgucauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgaggugcccucgcccuacaacucccgguucgagagcguggccuggagcgcguccgccugccacgacgggaucaacuggcucaccaucggcaucagcggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 20786 - RNA, 1410 nt, Artificial Sequence; identical to SEQ ID NO: 20732
  derived and/or modified CDS sequence (AUadapt) from InfluenzaA__ADD97971__NA

SEQ ID NO: 20787 - RNA, 1410 nt, Artificial Sequence; identical to SEQ ID NO: 16318
  derived and/or modified CDS sequence (AUadapt) from InfluenzaA__ADD97981__NA

SEQ ID NO: 20788 - RNA, 1410 nt, Artificial Sequence
  derived and/or modified CDS sequence (AUadapt) from InfluenzaA__ADD97991__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaucggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20789 - RNA, 1410 nt, Artificial Sequence
  derived and/or modified CDS sequence (AUadapt) from InfluenzaA__ADD98001__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacucgaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccgugaaguccuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20790 - RNA, 1410 nt, Artificial Sequence; identical to SEQ ID NO: 16318
  derived and/or modified CDS sequence (AUadapt) from InfluenzaA__ADD98011__NA

SEQ ID NO: 20791 - RNA, 1410 nt, Artificial Sequence; identical to SEQ ID NO: 16318
  derived and/or modified CDS sequence (AUadapt) from InfluenzaA__ADD98031__NA

SEQ ID NO: 20792 - RNA, 1410 nt, Artificial Sequence; identical to SEQ ID NO: 20789
  derived and/or modified CDS sequence (AUadapt) from InfluenzaA__ADD98041__NA

SEQ ID NO: 20793 - RNA, 1410 nt, Artificial Sequence; identical to SEQ ID NO: 16318
  derived and/or modified CDS sequence (AUadapt) from InfluenzaA__ADD98051__NA

SEQ ID NO: 20794 - RNA, 1410 nt, Artificial Sequence; identical to SEQ ID NO: 16318
  derived and/or modified CDS sequence (AUadapt) from InfluenzaA__ADD98061__NA

SEQ ID NO: 20795 - RNA, 1410 nt, Artificial Sequence; identical to SEQ ID NO: 16318
  derived and/or modified CDS sequence (AUadapt) from InfluenzaA__ADD98071__NA

SEQ ID NO: 20796 - RNA, 1410 nt, Artificial Sequence; identical to SEQ ID NO: 16318
  derived and/or modified CDS sequence (AUadapt) from InfluenzaA__ADD98081__NA

SEQ ID NO: 20797 - RNA, 1410 nt, Artificial Sequence; identical to SEQ ID NO: 16318
  derived and/or modified CDS sequence (AUadapt) from InfluenzaA__ADD98091__NA

SEQ ID NO: 20798 - RNA, 1410 nt, Artificial Sequence; identical to SEQ ID NO: 19966
  derived and/or modified CDS sequence (AUadapt) from InfluenzaA__ADD98101__NA

SEQ ID NO: 20799 - RNA, 1410 nt, Artificial Sequence
  derived and/or modified CDS sequence (AUadapt) from InfluenzaA__ADD98111__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcauccugggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20800 - RNA, 1410 nt, Artificial Sequence; identical to SEQ ID NO: 16318
  derived and/or modified CDS sequence (AUadapt) from InfluenzaA__ADD98121__NA

SEQ ID NO: 20801 - RNA, 1410 nt, Artificial Sequence; identical to SEQ ID NO: 16318
  derived and/or modified CDS sequence (AUadapt) from InfluenzaA__ADD98131__NA

SEQ ID NO: 20802 - RNA, 1410 nt, Artificial Sequence; identical to SEQ ID NO: 16318
  derived and/or modified CDS sequence (AUadapt) from InfluenzaA__ADD98141__NA

SEQ ID NO: 20803 - RNA, 1410 nt, Artificial Sequence; identical to SEQ ID NO: 16318
  derived and/or modified CDS sequence (AUadapt) from InfluenzaA__ADD98151__NA

SEQ ID NO: 20804 - RNA, 1410 nt, Artificial Sequence
  derived and/or modified CDS sequence (AUadapt) from InfluenzaA__ADD98161__NA
augaaccccaaccagaagaucaucaccaucggcucggugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggacgaucaaggaccggucgcccuaccgcacccugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggacccgcacggacaacaacuucuccaucaagcaggacaucgugggcaucaacgaguggagcggguacuccggcucguucgugcagcacccggagcugaccgggcuggacugcauccggcccugcuucugggucgagcucauccgcggccggcccaaggagaacaccaucuggaccuccggcagcuccaucagcuucugcggggugaacuccgacacggucggcuggagcuggcccgacggggccgagcugccguucaccaucgacaaguga

SEQ ID NO: 20805 - RNA, 1410 nt, Artificial Sequence
  derived and/or modified CDS sequence (AUadapt) from InfluenzaA__ADD98171__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagacggucgugagcgugaagcuggccgggaacuccagccucugcccggucuccggcugggccaucuacucgaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcgguccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 20806 - RNA, 1410 nt, Artificial Sequence
  derived and/or modified CDS sequence (AUadapt) from InfluenzaA__ADD98181__NA
augaaccccaaccagaagaucaucaccaucggcucggugugcaugaccaucgggauggccaaccugauccuccagaucggcaacaugaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 20807 - RNA, 1410 nt, Artificial Sequence; identical to SEQ ID NO: 16318
  derived and/or modified CDS sequence (AUadapt) from InfluenzaA__ADD98201__NA

SEQ ID NO: 20808 - RNA, 1410 nt, Artificial Sequence; identical to SEQ ID NO: 16318
  derived and/or modified CDS sequence (AUadapt) from InfluenzaA__ADD98211__NA

SEQ ID NO: 20809 - RNA, 1410 nt, Artificial Sequence; identical to SEQ ID NO: 20363
  derived and/or modified CDS sequence (AUadapt) from InfluenzaA__ADE20324__NA

SEQ ID NO: 20810 - RNA, 1410 nt, Artificial Sequence; identical to SEQ ID NO: 20363
  derived and/or modified CDS sequence (AUadapt) from InfluenzaA__ADE20334__NA

SEQ ID NO: 20811 - RNA, 1410 nt, Artificial Sequence; identical to SEQ ID NO: 20363
  derived and/or modified CDS sequence (AUadapt) from InfluenzaA__ADE20344__NA

SEQ ID NO: 20812 - RNA, 1410 nt, Artificial Sequence; identical to SEQ ID NO: 20363
  derived and/or modified CDS sequence (AUadapt) from InfluenzaA__ADE20354__NA

SEQ ID NO: 20813 - RNA, 1410 nt, Artificial Sequence; identical to SEQ ID NO: 20363
  derived and/or modified CDS sequence (AUadapt) from InfluenzaA__ADE20378__NA

SEQ ID NO: 20814 - RNA, 1410 nt, Artificial Sequence; identical to SEQ ID NO: 20363
  derived and/or modified CDS sequence (AUadapt) from InfluenzaA__ADE20391__NA

SEQ ID NO: 20815 - RNA, 1410 nt, Artificial Sequence; identical to SEQ ID NO: 20363
  derived and/or modified CDS sequence (AUadapt) from InfluenzaA__ADE20631__NA

SEQ ID NO: 20816 - RNA, 1410 nt, Artificial Sequence; identical to SEQ ID NO: 20363
  derived and/or modified CDS sequence (AUadapt) from InfluenzaA__ADE20641__NA

SEQ ID NO: 20817 - RNA, 1410 nt, Artificial Sequence
  derived and/or modified CDS sequence (AUadapt) from InfluenzaA__ADE20651__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugucgggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucggucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggcgagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 20818 - RNA, 1410 nt, Artificial Sequence; identical to SEQ ID NO: 20363
  derived and/or modified CDS sequence (AUadapt) from InfluenzaA__ADE20661__NA

SEQ ID NO: 20819 - RNA, 1410 nt, Artificial Sequence; identical to SEQ ID NO: 20363
  derived and/or modified CDS sequence (AUadapt) from InfluenzaA__ADE20671__NA

SEQ ID NO: 20820 - RNA, 1410 nt, Artificial Sequence; identical to SEQ ID NO: 20363
  derived and/or modified CDS sequence (AUadapt) from InfluenzaA__ADE20681__NA

SEQ ID NO: 20821 - RNA, 1410 nt, Artificial Sequence
  derived and/or modified CDS sequence (AUadapt) from InfluenzaA__ADE20701__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcgugaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 20822 - RNA, 1410 nt, Artificial Sequence; identical to SEQ ID NO: 20363
  derived and/or modified CDS sequence (AUadapt) from InfluenzaA__ADE20711__NA

SEQ ID NO: 20823 - RNA, 1410 nt, Artificial Sequence
  derived and/or modified CDS sequence (AUadapt) from InfluenzaA__ADE20721__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugucgggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucggucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgaccgguga

SEQ ID NO: 20824 - RNA, 1410 nt, Artificial Sequence; identical to SEQ ID NO: 20821
  derived and/or modified CDS sequence (AUadapt) from InfluenzaA__ADE20731__NA

SEQ ID NO: 20825 - RNA, 1410 nt, Artificial Sequence; identical to SEQ ID NO: 20363
  derived and/or modified CDS sequence (AUadapt) from InfluenzaA__ADE20741__NA

SEQ ID NO: 20826 - RNA, 1410 nt, Artificial Sequence; identical to SEQ ID NO: 20363
  derived and/or modified CDS sequence (AUadapt) from InfluenzaA__ADE20751__NA

SEQ ID NO: 20827 - RNA, 1410 nt, Artificial Sequence; identical to SEQ ID NO: 20821
  derived and/or modified CDS sequence (AUadapt) from InfluenzaA__ADE20761__NA

SEQ ID NO: 20828 - RNA, 1410 nt, Artificial Sequence; identical to SEQ ID NO: 20821
  derived and/or modified CDS sequence (AUadapt) from InfluenzaA__ADE20781__NA

SEQ ID NO: 20829 - RNA, 1410 nt, Artificial Sequence; identical to SEQ ID NO: 16318
  derived and/or modified CDS sequence (AUadapt) from InfluenzaA__ADE20791__NA

SEQ ID NO: 20830 - RNA, 1410 nt, Artificial Sequence; identical to SEQ ID NO: 16318
  derived and/or modified CDS sequence (AUadapt) from InfluenzaA__ADE20801__NA

SEQ ID NO: 20831 - RNA, 1410 nt, Artificial Sequence; identical to SEQ ID NO: 16318
  derived and/or modified CDS sequence (AUadapt) from InfluenzaA__ADE20811__NA

SEQ ID NO: 20832 - RNA, 1410 nt, Artificial Sequence; identical to SEQ ID NO: 16318
  derived and/or modified CDS sequence (AUadapt) from InfluenzaA__ADE20821__NA

SEQ ID NO: 20833 - RNA, 1410 nt, Artificial Sequence; identical to SEQ ID NO: 16318
  derived and/or modified CDS sequence (AUadapt) from InfluenzaA__ADE20831__NA

SEQ ID NO: 20834 - RNA, 1410 nt, Artificial Sequence; identical to SEQ ID NO: 16318
  derived and/or modified CDS sequence (AUadapt) from InfluenzaA__ADE20841__NA

SEQ ID NO: 20835 - RNA, 1410 nt, Artificial Sequence; identical to SEQ ID NO: 16318
  derived and/or modified CDS sequence (AUadapt) from InfluenzaA__ADE20851__NA

SEQ ID NO: 20836 - RNA, 1410 nt, Artificial Sequence; identical to SEQ ID NO: 20756
  derived and/or modified CDS sequence (AUadapt) from InfluenzaA__ADE20861__NA

SEQ ID NO: 20837 - RNA, 1410 nt, Artificial Sequence; identical to SEQ ID NO: 16318
  derived and/or modified CDS sequence (AUadapt) from InfluenzaA__ADE20871__NA

SEQ ID NO: 20838 - RNA, 1410 nt, Artificial Sequence; identical to SEQ ID NO: 20752
  derived and/or modified CDS sequence (AUadapt) from InfluenzaA__ADE20881__NA

SEQ ID NO: 20839 - RNA, 1410 nt, Artificial Sequence; identical to SEQ ID NO: 16318
  derived and/or modified CDS sequence (AUadapt) from InfluenzaA__ADE20891__NA

SEQ ID NO: 20840 - RNA, 1410 nt, Artificial Sequence; identical to SEQ ID NO: 16318
  derived and/or modified CDS sequence (AUadapt) from InfluenzaA__ADE20901__NA

SEQ ID NO: 20841 - RNA, 1410 nt, Artificial Sequence; identical to SEQ ID NO: 16318
  derived and/or modified CDS sequence (AUadapt) from InfluenzaA__ADE20911__NA

SEQ ID NO: 20842 - RNA, 1410 nt, Artificial Sequence; identical to SEQ ID NO: 16318
  derived and/or modified CDS sequence (AUadapt) from InfluenzaA__ADE20921__NA

SEQ ID NO: 20843 - RNA, 1410 nt, Artificial Sequence
  derived and/or modified CDS sequence (AUadapt) from InfluenzaA__ADE20931__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagucguggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccgugcuguccaacggggccaacggcgugaagggguucagcuucaaguacggcaacggggucuggaucggccgcaccaaguccaucggcagccggaacggguucgagaugaucugggaccccaacggcuggaccgggaccgacaacaacuucucgaucaagcaggacaucgugggcaucaacgagugguccggguacagcggcuccuucgugcagcacccggagcugacgggccucgacugcauccgccccugcuucugggucgagcugauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 20844 - RNA, 1410 nt, Artificial Sequence; identical to SEQ ID NO: 16318
  derived and/or modified CDS sequence (AUadapt) from InfluenzaA__ADE20941__NA

SEQ ID NO: 20845 - RNA, 1410 nt, Artificial Sequence
  derived and/or modified CDS sequence (AUadapt) from InfluenzaA__ADE20951__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacgugguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20846 - RNA, 1410 nt, Artificial Sequence
  derived and/or modified CDS sequence (AUadapt) from InfluenzaA__ADE20961__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacgacaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 20847 - RNA, 1410 nt, Artificial Sequence; identical to SEQ ID NO: 16318
  derived and/or modified CDS sequence (AUadapt) from InfluenzaA__ADE20971__NA

SEQ ID NO: 20848 - RNA, 1410 nt, Artificial Sequence; identical to SEQ ID NO: 20756
  derived and/or modified CDS sequence (AUadapt) from InfluenzaA__ADE20981__NA

SEQ ID NO: 20849 - RNA, 1410 nt, Artificial Sequence; identical to SEQ ID NO: 16318
  derived and/or modified CDS sequence (AUadapt) from InfluenzaA__ADE20991__NA

SEQ ID NO: 20850 - RNA, 1410 nt, Artificial Sequence
  derived and/or modified CDS sequence (AUadapt) from InfluenzaA__ADE21001__NA
augaaccccaaccagaagaucaucaccaucggcucggugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugagcgugaagcuggccgggaacuccucgcucugcccggucuccggcugggccaucuacagcaaggacaacuccauccgcaucggcagcaagggggacguguucaucauccgggagcccuucaucuccugcagcccccuggagugccgcaccuucuuccugacccagggcgcccuccugaacgacaagcacuccaacgggacgaucaaggaccggucgcccuaccgcacccugauguccugcccgaucggcgaggugcccagccccuacaacucccgguucgagagcgucgccuggagcgcguccgccugccacgacgggaucaacuggcucaccaucggcaucucgggccccgacaacggggccguggccgugcugaaguacaacggcaucaucaccgacacgaucaaguccuggcgcaacaacauccugcggacccaggagagcgagugcgcgugcgucaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaaguccaucagcagccggaacggcuucgagaugaucugggaccccaacggguggaccggcacggacaacaacuucuccaucaagcaggacaucgucgggaucaacgaguggagcggcuacuccgggucguucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 20851 - RNA, 1410 nt, Artificial Sequence; identical to SEQ ID NO: 16318
  derived and/or modified CDS sequence (AUadapt) from InfluenzaA__ADE21011__NA

SEQ ID NO: 20852 - RNA, 1410 nt, Artificial Sequence; identical to SEQ ID NO: 16318
  derived and/or modified CDS sequence (AUadapt) from InfluenzaA__ADE21021__NA

SEQ ID NO: 20853 - RNA, 1410 nt, Artificial Sequence; identical to SEQ ID NO: 20789
  derived and/or modified CDS sequence (AUadapt) from InfluenzaA__ADE21031__NA

SEQ ID NO: 20854 - RNA, 1410 nt, Artificial Sequence
  derived and/or modified CDS sequence (AUadapt) from InfluenzaA__ADE21041__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccaucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20855 - RNA, 1410 nt, Artificial Sequence; identical to SEQ ID NO: 16318
  derived and/or modified CDS sequence (AUadapt) from InfluenzaA__ADE21051__NA

SEQ ID NO: 20856 - RNA, 1410 nt, Artificial Sequence
  derived and/or modified CDS sequence (AUadapt) from InfluenzaA__ADE21071__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaaguucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20857 - RNA, 1413 nt, Artificial Sequence; identical to SEQ ID NO: 19034
  derived and/or modified CDS sequence (AUadapt) from InfluenzaA__ADE28752__NA

SEQ ID NO: 20858 - RNA, 1413 nt, Artificial Sequence; identical to SEQ ID NO: 19863
  derived and/or modified CDS sequence (AUadapt) from InfluenzaA__ADE28763__NA

SEQ ID NO: 20859 - RNA, 1410 nt, Artificial Sequence; identical to SEQ ID NO: 20363
  derived and/or modified CDS sequence (AUadapt) from InfluenzaA__ADE28773__NA

SEQ ID NO: 20860 - RNA, 1410 nt, Artificial Sequence; identical to SEQ ID NO: 20363
  derived and/or modified CDS sequence (AUadapt) from InfluenzaA__ADE28783__NA

SEQ ID NO: 20861 - RNA, 1410 nt, Artificial Sequence; identical to SEQ ID NO: 20821
  derived and/or modified CDS sequence (AUadapt) from InfluenzaA__ADE28803__NA

SEQ ID NO: 20862 - RNA, 1410 nt, Artificial Sequence; identical to SEQ ID NO: 16318
  derived and/or modified CDS sequence (AUadapt) from InfluenzaA__ADE28813__NA

SEQ ID NO: 20863 - RNA, 1410 nt, Artificial Sequence; identical to SEQ ID NO: 16318
  derived and/or modified CDS sequence (AUadapt) from InfluenzaA__ADE28823__NA

SEQ ID NO: 20864 - RNA, 1410 nt, Artificial Sequence
  derived and/or modified CDS sequence (AUadapt) from InfluenzaA__ADE28843__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccggugggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 20865 - RNA, 1410 nt, Artificial Sequence
  derived and/or modified CDS sequence (AUadapt) from InfluenzaA__ADE28853__NA
augaaccccaaccagaagaucaucaccaucgugucggucugcaugaccaucggcauggccaaccugauccuccagaucgggaacaucaucuccaucuggaucagccacuccauccagcugggcaaccagaaccagaucgagacgugcaaccagagcgugaucaccuacgagaacaacaccugggugaaccagaccuacgucaacaucuccaacacgaacuucgccgcggggcagagcgugguguccgucaagcuggccggcaacagcucccucugcccggugucggggugggccaucuacuccaaggacaacagcgugcgcaucggcuccaagggcgacgucuucgugauccgggagcccuucaucagcugcagcccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagucggucgccugguccgcgagcgccugccacgacggcaucaacuggcucaccaucgggaucuccggccccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacgggccguccaacggccaggccagcuacaagaucuuccgcaucgagaagggcaagaucgugaaguccgucgagaugaacgcccccaacuaccacuacgaggagugcucgugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucucgucccggaacggcuucgagaugaucugggaccccaacggcuggaccgggaccgacaacaacuucagcaucaagcaggacaucgucggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgugggcugguccuggcccgacggggccgagcugccguucacgaucgacaaguga

SEQ ID NO: 20866 - RNA, 1410 nt, Artificial Sequence; identical to SEQ ID NO: 20864
  derived and/or modified CDS sequence (AUadapt) from InfluenzaA__ADE28884__NA

SEQ ID NO: 20867 - RNA, 1410 nt, Artificial Sequence
  derived and/or modified CDS sequence (AUadapt) from InfluenzaA__ADE28894__NA
augaaccccaaccagaagaucaucaccaucggcucggugugcaugaccaucgggauggccaaccugauccuccagaucggcaacaucaucuccaucuggaucagccacuccguccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccaacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 20868 - RNA, 1410 nt, Artificial Sequence; identical to SEQ ID NO: 20788
  derived and/or modified CDS sequence (AUadapt) from InfluenzaA__ADE28904__NA

SEQ ID NO: 20869 - RNA, 1410 nt, Artificial Sequence; identical to SEQ ID NO: 16318
  derived and/or modified CDS sequence (AUadapt) from InfluenzaA__ADE28914__NA

SEQ ID NO: 20870 - RNA, 1410 nt, Artificial Sequence; identical to SEQ ID NO: 16318
  derived and/or modified CDS sequence (AUadapt) from InfluenzaA__ADE28924__NA

SEQ ID NO: 20871 - RNA, 1410 nt, Artificial Sequence
  derived and/or modified CDS sequence (AUadapt) from InfluenzaA__ADE28934__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcaucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20872 - RNA, 1410 nt, Artificial Sequence; identical to SEQ ID NO: 16318
  derived and/or modified CDS sequence (AUadapt) from InfluenzaA__ADE28954__NA

SEQ ID NO: 20873 - RNA, 1410 nt, Artificial Sequence
  derived and/or modified CDS sequence (AUadapt) from InfluenzaA__ADE28964__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacaucaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20874 - RNA, 1410 nt, Artificial Sequence; identical to SEQ ID NO: 16318
  derived and/or modified CDS sequence (AUadapt) from InfluenzaA__ADE28974__NA

SEQ ID NO: 20875 - RNA, 1410 nt, Artificial Sequence
  derived and/or modified CDS sequence (AUadapt) from InfluenzaA__ADE29004__NA
augaaccccaaccagaagaucaucaccaucggcucggugugcaugaccaucgggcuggccaaccucauccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacucgucccugugcccggucagcggcugggccaucuacuccaaggacaacagcgugcgcaucggcuccaagggggacguguucgucauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgaggugcccucccccuacaacagccgguucgagagcguggccugguccgcgagcgccugccacgacgggaucaacuggcugaccaucggcaucuccggccccgacaacggggccgucgccgugcugaaguacaacggcaucaucaccgacaccaucaagagcuggcgcaacaacauccuccggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccuggaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaagaacuucucgaucaagcaggacaucguggggaucaacgagugguccggcuacagcggguccuucguccagcacccggagcugacgggccucgacugcauccggcccugcuucuggguggagcugauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 20876 - RNA, 1410 nt, Artificial Sequence; identical to SEQ ID NO: 16318
  derived and/or modified CDS sequence (AUadapt) from InfluenzaA__ADE29014__NA

SEQ ID NO: 20877 - RNA, 1410 nt, Artificial Sequence
  derived and/or modified CDS sequence (AUadapt) from InfluenzaA__ADE29024__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaacggcaccgacaacaacuucucgaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgccgagcugccguucaccaucgacaaguga

SEQ ID NO: 20878 - RNA, 1410 nt, Artificial Sequence; identical to SEQ ID NO: 16318
  derived and/or modified CDS sequence (AUadapt) from InfluenzaA__ADE29034__NA

SEQ ID NO: 20879 - RNA, 1410 nt, Artificial Sequence; identical to SEQ ID NO: 16318
  derived and/or modified CDS sequence (AUadapt) from InfluenzaA__ADE29044__NA

SEQ ID NO: 20880 - RNA, 1410 nt, Artificial Sequence; identical to SEQ ID NO: 16318
  derived and/or modified CDS sequence (AUadapt) from InfluenzaA__ADE29054__NA

SEQ ID NO: 20881 - RNA, 1410 nt, Artificial Sequence; identical to SEQ ID NO: 20428
  derived and/or modified CDS sequence (AUadapt) from InfluenzaA__ADE29064__NA

SEQ ID NO: 20882 - RNA, 1410 nt, Artificial Sequence
  derived and/or modified CDS sequence (AUadapt) from InfluenzaA__ADE29087__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugcaagaccuucuuccugacccagggcgcccuccugaacgacaagcacuccaacgggaccaucaaggaccgcucccccuaccggacgcugaugucgugcccgaucggcgaggugcccucccccuacaacagccgcuucgagagcguggccugguccgcgagcgccugccacgacgggaucaacuggcucaccaucggcaucuccggccccgacaacggggccgucgccgugcugaaguacaacggcaucaucaccgacaccaucaagagcuggcggaacaacauccugcgcacgcaggaguccgagugcgcgugcgugaacgggucgugcuucaccgucaugaccgacggcccguccaacggccaggccagcuacaagaucuuccggaucgagaaggggaagaucgugaaguccguggagaugaacgcccccaacuaccacuacgaggagugcagcugcuaccccgacuccagcgagaucacgugcgucugccgcgacaacuggcacggcuccaaccggcccugggugucguucaaccagaaccucgaguaccagaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 20883 - RNA, 1410 nt, Artificial Sequence; identical to SEQ ID NO: 16274
  derived and/or modified CDS sequence (AUadapt) from InfluenzaA__ADE29097__NA

SEQ ID NO: 20884 - RNA, 1410 nt, Artificial Sequence; identical to SEQ ID NO: 20007
  derived and/or modified CDS sequence (AUadapt) from InfluenzaA__ADE34194__NA

SEQ ID NO: 20885 - RNA, 1410 nt, Artificial Sequence; identical to SEQ ID NO: 19001
  derived and/or modified CDS sequence (AUadapt) from InfluenzaA__ADE34205__NA

SEQ ID NO: 20886 - RNA, 1410 nt, Artificial Sequence
  derived and/or modified CDS sequence (AUadapt) from InfluenzaA__ADE34216__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 20887 - RNA, 1410 nt, Artificial Sequence; identical to SEQ ID NO: 20007
  derived and/or modified CDS sequence (AUadapt) from InfluenzaA__ADE34227__NA

SEQ ID NO: 20888 - RNA, 1410 nt, Artificial Sequence; identical to SEQ ID NO: 20007
  derived and/or modified CDS sequence (AUadapt) from InfluenzaA__ADE34238__NA

SEQ ID NO: 20889 - RNA, 1410 nt, Artificial Sequence
  derived and/or modified CDS sequence (AUadapt) from InfluenzaA__ADE34260__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugauguccaucuga

SEQ ID NO: 20890 - RNA, 1410 nt, Artificial Sequence; identical to SEQ ID NO: 20007
  derived and/or modified CDS sequence (AUadapt) from InfluenzaA__ADE34271__NA

SEQ ID NO: 20891 - RNA, 1410 nt, Artificial Sequence; identical to SEQ ID NO: 16318
  derived and/or modified CDS sequence (AUadapt) from InfluenzaA__ADE45502__NA

SEQ ID NO: 20892 - RNA, 1410 nt, Artificial Sequence; identical to SEQ ID NO: 16318
  derived and/or modified CDS sequence (AUadapt) from InfluenzaA__ADE45504__NA

SEQ ID NO: 20893 - RNA, 1410 nt, Artificial Sequence; identical to SEQ ID NO: 16318
  derived and/or modified CDS sequence (AUadapt) from InfluenzaA__ADE45506__NA

SEQ ID NO: 20894 - RNA, 1410 nt, Artificial Sequence; identical to SEQ ID NO: 16318
  derived and/or modified CDS sequence (AUadapt) from InfluenzaA__ADE45508__NA

SEQ ID NO: 20895 - RNA, 1410 nt, Artificial Sequence; identical to SEQ ID NO: 16318
  derived and/or modified CDS sequence (AUadapt) from InfluenzaA__ADE45510__NA

SEQ ID NO: 20896 - RNA, 1410 nt, Artificial Sequence; identical to SEQ ID NO: 16318
  derived and/or modified CDS sequence (AUadapt) from InfluenzaA__ADE45512__NA

SEQ ID NO: 20897 - RNA, 1410 nt, Artificial Sequence
  derived and/or modified CDS sequence (AUadapt) from InfluenzaA__ADE45514__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuuccaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20898 - RNA, 1410 nt, Artificial Sequence
  derived and/or modified CDS sequence (AUadapt) from InfluenzaA__ADE45516__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagccugcggaacggcuucgagaugaucugggaccccaacggguggaccggcaccgacaacaacuucuccaucaagcaggacaucguggggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20899 - RNA, 1410 nt, Artificial Sequence
  derived and/or modified CDS sequence (AUadapt) from InfluenzaA__ADF10069__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcacccuccugaacgacaagcacuccaacgggacgaucaaggaccggucccccuaccgcacccugaugucgugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 20900 - RNA, 1410 nt, Artificial Sequence; identical to SEQ ID NO: 16318
  derived and/or modified CDS sequence (AUadapt) from InfluenzaA__ADF10079__NA

SEQ ID NO: 20901 - RNA, 1410 nt, Artificial Sequence; identical to SEQ ID NO: 16318
  derived and/or modified CDS sequence (AUadapt) from InfluenzaA__ADF10089__NA

SEQ ID NO: 20902 - RNA, 1410 nt, Artificial Sequence; identical to SEQ ID NO: 16318
  derived and/or modified CDS sequence (AUadapt) from InfluenzaA__ADF10099__NA

SEQ ID NO: 20903 - RNA, 1410 nt, Artificial Sequence
  derived and/or modified CDS sequence (AUadapt) from InfluenzaA__ADF10109__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcaacugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20904 - RNA, 1410 nt, Artificial Sequence; identical to SEQ ID NO: 16318
  derived and/or modified CDS sequence (AUadapt) from InfluenzaA__ADF10129__NA

SEQ ID NO: 20905 - RNA, 1410 nt, Artificial Sequence; identical to SEQ ID NO: 20570
  derived and/or modified CDS sequence (AUadapt) from InfluenzaA__ADF10146__NA

SEQ ID NO: 20906 - RNA, 1410 nt, Artificial Sequence
  derived and/or modified CDS sequence (AUadapt) from InfluenzaA__ADF10166__NA
augaaccccaaccagaagaucaucaccaucggcucggugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaagggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20907 - RNA, 1410 nt, Artificial Sequence; identical to SEQ ID NO: 20906
  derived and/or modified CDS sequence (AUadapt) from InfluenzaA__ADF10176__NA

SEQ ID NO: 20908 - RNA, 1410 nt, Artificial Sequence; identical to SEQ ID NO: 20906
  derived and/or modified CDS sequence (AUadapt) from InfluenzaA__ADF10192__NA

SEQ ID NO: 20909 - RNA, 1410 nt, Artificial Sequence; identical to SEQ ID NO: 16318
  derived and/or modified CDS sequence (AUadapt) from InfluenzaA__ADF10247__NA

SEQ ID NO: 20910 - RNA, 1410 nt, Artificial Sequence; identical to SEQ ID NO: 20906
  derived and/or modified CDS sequence (AUadapt) from InfluenzaA__ADF10290__NA

SEQ ID NO: 20911 - RNA, 1410 nt, Artificial Sequence
  derived and/or modified CDS sequence (AUadapt) from InfluenzaA__ADF10304__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccggccugccguucacgaucgacaaguga

SEQ ID NO: 20912 - RNA, 1410 nt, Artificial Sequence; identical to SEQ ID NO: 16318
  derived and/or modified CDS sequence (AUadapt) from InfluenzaA__ADF10340__NA

SEQ ID NO: 20913 - RNA, 1410 nt, Artificial Sequence; identical to SEQ ID NO: 16318
  derived and/or modified CDS sequence (AUadapt) from InfluenzaA__ADF10361__NA

SEQ ID NO: 20914 - RNA, 1410 nt, Artificial Sequence; identical to SEQ ID NO: 20906
  derived and/or modified CDS sequence (AUadapt) from InfluenzaA__ADF10371__NA

SEQ ID NO: 20915 - RNA, 1410 nt, Artificial Sequence; identical to SEQ ID NO: 20906
  derived and/or modified CDS sequence (AUadapt) from InfluenzaA__ADF10407__NA

SEQ ID NO: 20916 - RNA, 1410 nt, Artificial Sequence; identical to SEQ ID NO: 16318
  derived and/or modified CDS sequence (AUadapt) from InfluenzaA__ADF10472__NA

SEQ ID NO: 20917 - RNA, 1410 nt, Artificial Sequence; identical to SEQ ID NO: 20906
  derived and/or modified CDS sequence (AUadapt) from InfluenzaA__ADF10616__NA

SEQ ID NO: 20918 - RNA, 1410 nt, Artificial Sequence; identical to SEQ ID NO: 20906
  derived and/or modified CDS sequence (AUadapt) from InfluenzaA__ADF10688__NA

SEQ ID NO: 20919 - RNA, 1410 nt, Artificial Sequence; identical to SEQ ID NO: 20906
  derived and/or modified CDS sequence (AUadapt) from InfluenzaA__ADF10726__NA

SEQ ID NO: 20920 - RNA, 1410 nt, Artificial Sequence; identical to SEQ ID NO: 16318
  derived and/or modified CDS sequence (AUadapt) from InfluenzaA__ADF10773__NA

SEQ ID NO: 20921 - RNA, 1410 nt, Artificial Sequence
  derived and/or modified CDS sequence (AUadapt) from InfluenzaA__ADF10837__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 20922 - RNA, 1410 nt, Artificial Sequence; identical to SEQ ID NO: 16318
  derived and/or modified CDS sequence (AUadapt) from InfluenzaA__ADF10889__NA

SEQ ID NO: 20923 - RNA, 1410 nt, Artificial Sequence; identical to SEQ ID NO: 16318
  derived and/or modified CDS sequence (AUadapt) from InfluenzaA__ADF10947__NA

SEQ ID NO: 20924 - RNA, 1410 nt, Artificial Sequence; identical to SEQ ID NO: 16318
  derived and/or modified CDS sequence (AUadapt) from InfluenzaA__ADF11010__NA

SEQ ID NO: 20925 - RNA, 1410 nt, Artificial Sequence
  derived and/or modified CDS sequence (AUadapt) from InfluenzaA__ADF27355__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaugggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20926 - RNA, 1410 nt, Artificial Sequence
  derived and/or modified CDS sequence (AUadapt) from InfluenzaA__ADF27356__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagaacgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuacuacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 20927 - RNA, 1410 nt, Artificial Sequence; identical to SEQ ID NO: 19494
  derived and/or modified CDS sequence (AUadapt) from InfluenzaA__ADF27357__NA

SEQ ID NO: 20928 - RNA, 1410 nt, Artificial Sequence; identical to SEQ ID NO: 19494
  derived and/or modified CDS sequence (AUadapt) from InfluenzaA__ADF27358__NA

SEQ ID NO: 20929 - RNA, 1410 nt, Artificial Sequence; identical to SEQ ID NO: 19494
  derived and/or modified CDS sequence (AUadapt) from InfluenzaA__ADF27360__NA

SEQ ID NO: 20930 - RNA, 1410 nt, Artificial Sequence; identical to SEQ ID NO: 16318
  derived and/or modified CDS sequence (AUadapt) from InfluenzaA__ADF27361__NA

SEQ ID NO: 20931 - RNA, 1410 nt, Artificial Sequence; identical to SEQ ID NO: 16318
  derived and/or modified CDS sequence (AUadapt) from InfluenzaA__ADF27362__NA

SEQ ID NO: 20932 - RNA, 1410 nt, Artificial Sequence; identical to SEQ ID NO: 16318
  derived and/or modified CDS sequence (AUadapt) from InfluenzaA__ADF27363__NA

SEQ ID NO: 20933 - RNA, 1410 nt, Artificial Sequence; identical to SEQ ID NO: 19494
  derived and/or modified CDS sequence (AUadapt) from InfluenzaA__ADF27364__NA

SEQ ID NO: 20934 - RNA, 1410 nt, Artificial Sequence; identical to SEQ ID NO: 16318
  derived and/or modified CDS sequence (AUadapt) from InfluenzaA__ADF27365__NA

SEQ ID NO: 20935 - RNA, 1410 nt, Artificial Sequence; identical to SEQ ID NO: 19494
  derived and/or modified CDS sequence (AUadapt) from InfluenzaA__ADF27366__NA

SEQ ID NO: 20936 - RNA, 1410 nt, Artificial Sequence; identical to SEQ ID NO: 16318
  derived and/or modified CDS sequence (AUadapt) from InfluenzaA__ADF27382__NA

SEQ ID NO: 20937 - RNA, 1410 nt, Artificial Sequence; identical to SEQ ID NO: 16318
  derived and/or modified CDS sequence (AUadapt) from InfluenzaA__ADF27392__NA

SEQ ID NO: 20938 - RNA, 1410 nt, Artificial Sequence; identical to SEQ ID NO: 16318
  derived and/or modified CDS sequence (AUadapt) from InfluenzaA__ADF27402__NA

SEQ ID NO: 20939 - RNA, 1410 nt, Artificial Sequence; identical to SEQ ID NO: 20921
  derived and/or modified CDS sequence (AUadapt) from InfluenzaA__ADF27422__NA

SEQ ID NO: 20940 - RNA, 1410 nt, Artificial Sequence
  derived and/or modified CDS sequence (AUadapt) from InfluenzaA__ADF27432__NA
augaaccccaaccagaagaucaucaccaucggcucggugugcgucaccaucgggauggccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 20941 - RNA, 1410 nt, Artificial Sequence
  derived and/or modified CDS sequence (AUadapt) from InfluenzaA__ADF27442__NA
augaaccccaaccagaagaucaucaccaucggcucggugugcaugaccaucgggauggccaaccugauccuccagaucggcaacaucaucuccaucuggaucagccacuccauccagcuggagaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 20942 - RNA, 1410 nt, Artificial Sequence
  derived and/or modified CDS sequence (AUadapt) from InfluenzaA__ADF27462__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgaggccugcaaccagagcgucaucacguacgagaacaacaccugggugaaccagaccuacgugaacaucuccaacaccaacuucgcggccggccagagcgucguguccgugaagcuggccgggaacucgucccucugcccggucagcggcugggccguguacuccaaggacaacagcauccgcaucggcuccaagggggacguguucgucauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgaggugcccucccccuacaacagccgguucgagagcguggcgugguccgccagcgccugccacgacgggaucaacuggcucacgaucggcaucuccggccccgacaacggggccgucgcggugcugaaguacaacggcaucaucaccgacaccaucaagagcuggcgcaacaacauccugcggacccaggaguccgagugcgccugcgugaacgggucgugcuucacggucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgcggagcugccguucaccaucgacaaguga

SEQ ID NO: 20943 - RNA, 1410 nt, Artificial Sequence; identical to SEQ ID NO: 16318
  derived and/or modified CDS sequence (AUadapt) from InfluenzaA__ADF27472__NA

SEQ ID NO: 20944 - RNA, 1410 nt, Artificial Sequence
  derived and/or modified CDS sequence (AUadapt) from InfluenzaA__ADF27482__NA
augaaccccaaccagaagaucaucaccaucggcucggugugcaugaccaucgggauggccaaccugauccuccagaucggcaacaucaucuccaucuggaucagccacuccauccagcuggggaaccagaaccaggucgagacgugcaaccagagcaucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 20945 - RNA, 1410 nt, Artificial Sequence
  derived and/or modified CDS sequence (AUadapt) from InfluenzaA__ADF27492__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagccgugcaaccagagcgucaucacguacgagaacaacaccugggugaaccagaccuacgugaacaucuccaacaccaacuucgccgcgggccagagcgucguguccgugaagcuggccgggaacucgucccucugccccgucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccgguccccguaccgcacccugaugucgugccccaucggcgagguccccucccccuacaacagccgguucgagagcguggccugguccgcgagcgccugccacgacgggaucaacuggcucacgaucggcaucuccggcccggacaacggggccguggccguccugaaguacaacggcaucaucaccgacaccaucaagagcuggcgcaacaacauccugcggacccaggaguccgagugcgcgugcgugaacgggucgugcuucacggugaugaccgacggccccuccgacggccaggccagcuacaagaucuuccgcaucgagaaggggaagaucgucaaguccaucgagaugaacgcccccaacuaccacuacgaggagugcagcugcuaccccgacuccagcgagaucacgugcgugugccgggacaacuggcacggcuccaaccgcccgugggugucguucaaccagaaccucgaguaccagaucggguacaucugcuccggcaucuucggggacaacccccggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggacccgaacggguggaccggcaccgacaacaacuucucgaucaagcaggacaucgucgggaucaacgagugguccggcuacagcggguccuucgugcagcaccccgagcugaccggccuggacugcauccgccccugcuucuggguggagcucauccggggccgccccaaggagaacacggucuggaccagcggguccagcaucuccuucugcggcgugaacagcgacaccgucgggugguccuggccggacggcgccgagcugcccuucaccaucgacaaguga

SEQ ID NO: 20946 - RNA, 1410 nt, Artificial Sequence; identical to SEQ ID NO: 16318
  derived and/or modified CDS sequence (AUadapt) from InfluenzaA__ADF27502__NA

SEQ ID NO: 20947 - RNA, 1410 nt, Artificial Sequence; identical to SEQ ID NO: 16318
  derived and/or modified CDS sequence (AUadapt) from InfluenzaA__ADF27512__NA

SEQ ID NO: 20948 - RNA, 1410 nt, Artificial Sequence
  derived and/or modified CDS sequence (AUadapt) from InfluenzaA__ADF27522__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaucaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 20949 - RNA, 1410 nt, Artificial Sequence; identical to SEQ ID NO: 16318
  derived and/or modified CDS sequence (AUadapt) from InfluenzaA__ADF27532__NA

SEQ ID NO: 20950 - RNA, 1410 nt, Artificial Sequence
  derived and/or modified CDS sequence (AUadapt) from InfluenzaA__ADF27542__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 20951 - RNA, 1410 nt, Artificial Sequence
  derived and/or modified CDS sequence (AUadapt) from InfluenzaA__ADF27552__NA
augaaccccaaccagaagaucaucaccaucggcucggugugcaugaccaucgggcuggccaaccucauccugcagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcucgccgggaacucgucccugugcccggugagcggcugggccaucuacuccaaggacaacagcgugcgcaucggcuccaagggggacgucuucgugauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgaggugcccucccccuacaacagccgguucgagagcgucgccugguccgcgagcgccugccacgacgggaucaacuggcugaccaucggcaucuccggccccgacaacggggccguggccgugcugaaguacaacggcaucaucaccgacaccaucaagagcuggcgcaacaacauccuccggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccggaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaagaacuucucgaucaagcaggacaucgucgggaucaacgagugguccggcuacagcggguccuucgugcagcacccggagcugacgggccucgacugcauccggcccugcuucugggucgagcugauccgcggccggcccaaggagaacaccaucuggaccagcggguccagcaucuccuucugcggcgugaacagcgacaccguggggugguccuggcccgacggcgccgagcugccguucacgaucgacaaguga

SEQ ID NO: 20952 - RNA, 1410 nt, Artificial Sequence; identical to SEQ ID NO: 19966
  derived and/or modified CDS sequence (AUadapt) from InfluenzaA__ADF27562__NA

SEQ ID NO: 20953 - RNA, 1410 nt, Artificial Sequence; identical to SEQ ID NO: 16318
  derived and/or modified CDS sequence (AUadapt) from InfluenzaA__ADF27572__NA

SEQ ID NO: 20954 - RNA, 1410 nt, Artificial Sequence
  derived and/or modified CDS sequence (AUadapt) from InfluenzaA__ADF27582__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 20955 - RNA, 1410 nt, Artificial Sequence; identical to SEQ ID NO: 16318
  derived and/or modified CDS sequence (AUadapt) from InfluenzaA__ADF27592__NA

SEQ ID NO: 20956 - RNA, 1410 nt, Artificial Sequence
  derived and/or modified CDS sequence (AUadapt) from InfluenzaA__ADF27602__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagcgggggaagaucgucaaguccguggagaugaacgcccccaacuaccacuacgaggagugcagcugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcucgugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacagcuucuccaucaagcaggacaucguggggaucaacgaguggucgggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 20957 - RNA, 1410 nt, Artificial Sequence; identical to SEQ ID NO: 16318
  derived and/or modified CDS sequence (AUadapt) from InfluenzaA__ADF27612__NA

SEQ ID NO: 20958 - RNA, 1410 nt, Artificial Sequence; identical to SEQ ID NO: 20428
  derived and/or modified CDS sequence (AUadapt) from InfluenzaA__ADF27622__NA

SEQ ID NO: 20959 - RNA, 1410 nt, Artificial Sequence; identical to SEQ ID NO: 20875
  derived and/or modified CDS sequence (AUadapt) from InfluenzaA__ADF27632__NA

SEQ ID NO: 20960 - RNA, 1410 nt, Artificial Sequence; identical to SEQ ID NO: 16318
  derived and/or modified CDS sequence (AUadapt) from InfluenzaA__ADF27642__NA

SEQ ID NO: 20961 - RNA, 1410 nt, Artificial Sequence; identical to SEQ ID NO: 16318
  derived and/or modified CDS sequence (AUadapt) from InfluenzaA__ADF27652__NA

SEQ ID NO: 20962 - RNA, 1410 nt, Artificial Sequence
  derived and/or modified CDS sequence (AUadapt) from InfluenzaA__ADF27662__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugcaacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 20963 - RNA, 1410 nt, Artificial Sequence; identical to SEQ ID NO: 16318
  derived and/or modified CDS sequence (AUadapt) from InfluenzaA__ADF27672__NA

SEQ ID NO: 20964 - RNA, 1410 nt, Artificial Sequence; identical to SEQ ID NO: 16318
  derived and/or modified CDS sequence (AUadapt) from InfluenzaA__ADF27682__NA

SEQ ID NO: 20965 - RNA, 1410 nt, Artificial Sequence; identical to SEQ ID NO: 16318
  derived and/or modified CDS sequence (AUadapt) from InfluenzaA__ADF27692__NA

SEQ ID NO: 20966 - RNA, 1410 nt, Artificial Sequence; identical to SEQ ID NO: 16318
  derived and/or modified CDS sequence (AUadapt) from InfluenzaA__ADF27702__NA

SEQ ID NO: 20967 - RNA, 1410 nt, Artificial Sequence; identical to SEQ ID NO: 16318
  derived and/or modified CDS sequence (AUadapt) from InfluenzaA__ADF27712__NA

SEQ ID NO: 20968 - RNA, 1410 nt, Artificial Sequence; identical to SEQ ID NO: 20428
  derived and/or modified CDS sequence (AUadapt) from InfluenzaA__ADF27788__NA

SEQ ID NO: 20969 - RNA, 1410 nt, Artificial Sequence; identical to SEQ ID NO: 20383
  derived and/or modified CDS sequence (AUadapt) from InfluenzaA__ADF27798__NA

SEQ ID NO: 20970 - RNA, 1410 nt, Artificial Sequence; identical to SEQ ID NO: 20875
  derived and/or modified CDS sequence (AUadapt) from InfluenzaA__ADF27808__NA

SEQ ID NO: 20971 - RNA, 1410 nt, Artificial Sequence
  derived and/or modified CDS sequence (AUadapt) from InfluenzaA__ADF27818__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucaacagccggaacggcuucgagaugaucugggaccccaacggguggaccggcaccgacaacaacuucuccaucaagcaggacaucgucgggaucaacgaguggagcggcuacuccgggucguucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 20972 - RNA, 1410 nt, Artificial Sequence; identical to SEQ ID NO: 16318
  derived and/or modified CDS sequence (AUadapt) from InfluenzaA__ADF27838__NA

SEQ ID NO: 20973 - RNA, 1410 nt, Artificial Sequence; identical to SEQ ID NO: 16318
  derived and/or modified CDS sequence (AUadapt) from InfluenzaA__ADF27848__NA

SEQ ID NO: 20974 - RNA, 1410 nt, Artificial Sequence
  derived and/or modified CDS sequence (AUadapt) from InfluenzaA__ADF27858__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccagcuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgccugcgugaacggguccugcuucaccgugaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccucgcggaacggcuucgagaugaucugggaccccaacggguggaccggcaccgacaacaacuucuccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacggggacaccgucggcugguccuggcccgacggcgccgagcugccguucaccaucgacaaguga

SEQ ID NO: 20975 - RNA, 1410 nt, Artificial Sequence
  derived and/or modified CDS sequence (AUadapt) from InfluenzaA__ADF27878__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacacgaucuggaccagcggguccagcaucuccuucugcggcgugaacggggacaccgucggcuggagcuggcccgacggcgccgagcugccguucaccaucgacaaguga

SEQ ID NO: 20976 - RNA, 1410 nt, Artificial Sequence; identical to SEQ ID NO: 20428
  derived and/or modified CDS sequence (AUadapt) from InfluenzaA__ADF27888__NA

SEQ ID NO: 20977 - RNA, 1410 nt, Artificial Sequence; identical to SEQ ID NO: 16318
  derived and/or modified CDS sequence (AUadapt) from InfluenzaA__ADF27898__NA

SEQ ID NO: 20978 - RNA, 1410 nt, Artificial Sequence; identical to SEQ ID NO: 20428
  derived and/or modified CDS sequence (AUadapt) from InfluenzaA__ADF27908__NA

SEQ ID NO: 20979 - RNA, 1410 nt, Artificial Sequence; identical to SEQ ID NO: 20428
  derived and/or modified CDS sequence (AUadapt) from InfluenzaA__ADF27918__NA

SEQ ID NO: 20980 - RNA, 1410 nt, Artificial Sequence
  derived and/or modified CDS sequence (AUadapt) from InfluenzaA__ADF27938__NA
augaaccccaaccagcgcaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcauguccuucugcggcgugaacagcgacaccgucgggugguccuggcccgacggcgccgagcugccguucacgaucgacaaguga

SEQ ID NO: 20981 - RNA, 1410 nt, Artificial Sequence; identical to SEQ ID NO: 16318
  derived and/or modified CDS sequence (AUadapt) from InfluenzaA__ADF27948__NA

SEQ ID NO: 20982 - RNA, 1410 nt, Artificial Sequence; identical to SEQ ID NO: 20428
  derived and/or modified CDS sequence (AUadapt) from InfluenzaA__ADF27958__NA

SEQ ID NO: 20983 - RNA, 1410 nt, Artificial Sequence; identical to SEQ ID NO: 16318
  derived and/or modified CDS sequence (AUadapt) from InfluenzaA__ADF27968__NA

SEQ ID NO: 20984 - RNA, 1410 nt, Artificial Sequence; identical to SEQ ID NO: 20428
  derived and/or modified CDS sequence (AUadapt) from InfluenzaA__ADF27978__NA

SEQ ID NO: 20985 - RNA, 1410 nt, Artificial Sequence
  derived and/or modified CDS sequence (AUadapt) from InfluenzaA__ADF27988__NA
augaaccccaaccagaagaucaucaccaucggcucggugugcaugaccaucgggcuggccaaccucauccugcagaucggcaacaucaucuccaucuggaucagccacuccauccagcuggggaaccagaaccagaucgagacgugcaaccagagcgucaucuccuacgagaacaacaccugggugaaccagaccuacgugaacaucagcaacaccaacuucgccgcgggccaguccgucgugucggugaagcucgccgggaacuccagccugugcccggucuccggcugggccaucuacagcaaggacaacuccgugcgcaucggcagcaagggggacguguucgucauccgggagcccuucaucuccugcagcccccuggagugccgcacguucuuccucacccagggcgcccugcugaacgacaagcacuccaacgggaccaucaaggaccggucgcccuaccgcacccucauguccugcccgaucggcgaggugcccagccccuacaacagccgguucgaguccguggccuggagcgcguccgccugccacgacgggaucaacuggcugacgaucggcaucagcggccccgacaacggggccgucgccgugcugaaguacaacggcaucaucaccgacaccaucaaguccuggcgcaacaacauccuccggacccaggagucggagugcgcgugcgugaacggguccugcuucacggucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccuggaguaccggaucggguacaucugcucgggcaucuucggggacaacccgcgccccaacgacaagaccggcuccugcggccccgugagcuccaacggggccaacggcgucaagggguucagcuucaaguacggcaacgggguguggaucggccggaccaagagcaucuccagccgcaacggcuucgagaugaucugggaccccaacggguggaccggcaccgacaagaacuucuccaucaagcaggacaucguggggaucaacgaguggucgggcuacuccgggagcuucguccagcacccggagcugaccggccucgacugcauccggcccugcuucuggguggagcugauccgcggccggcccaaggagaacacgaucuggaccuccgggagcuccaucagcuucugcggcgucaacuccgacaccgugggguggagcuggcccgacggcgccgagcugccguucaccaucgacaaguga

SEQ ID NO: 20986 - RNA, 1410 nt, Artificial Sequence; identical to SEQ ID NO: 16318
  derived and/or modified CDS sequence (AUadapt) from InfluenzaA__ADF27998__NA

SEQ ID NO: 20987 - RNA, 1410 nt, Artificial Sequence; identical to SEQ ID NO: 16318
  derived and/or modified CDS sequence (AUadapt) from InfluenzaA__ADF28008__NA

SEQ ID NO: 20988 - RNA, 1410 nt, Artificial Sequence; identical to SEQ ID NO: 20027
  derived and/or modified CDS sequence (AUadapt) from InfluenzaA__ADF28018__NA

SEQ ID NO: 20989 - RNA, 1410 nt, Artificial Sequence; identical to SEQ ID NO: 16318
  derived and/or modified CDS sequence (AUadapt) from InfluenzaA__ADF28028__NA

SEQ ID NO: 20990 - RNA, 1410 nt, Artificial Sequence
  derived and/or modified CDS sequence (AUadapt) from InfluenzaA__ADF28038__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccaccggccagcuggucgugagcgugaagcucgcggggaacuccucgcugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgaccggcacuccaacgggacgaucaaggaccgcagccccuaccggacccucauguccugcccgaucggcgagguccccucgcccuacaacucccgcuucgagagcguggccuggagcgccuccgcgugccacgacgggaucaacuggcugaccaucggcaucagcggccccgacaacggggccguggccguccugaaguacaacggcaucaucaccgacacgaucaaguccuggcggaacaacauccuccgcacccaggagagcgagugcgccugcgugaacggguccugcuucaccgugaugaccgacggcccgucggacggccaggcguccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccuggaguaccagaucggguacaucugcucgggcaucuucggggacaacccgcgccccaacgacaagaccggcuccugcggccccgugagcuccaacggggccaacggcgugaagggguucagcuucaaguacggcaacggggucuggaucggccggaccaaguccaucagcagccgcaacggcuucgagaugaucugggaccccaacggguggaccggcacggacaacaacuucuccaucaagcaggacaucguggggaucaacgaguggucgggcuacuccgggagcuucgugcagcacccggagcugaccggccucgacugcauccggcccugcuucugggucgagcugauccgcggccggcccaaggagaacaccaucuggaccuccgggagcuccaucagcuucugcggcgugaacuccgacacggucggguggagcuggcccgacggcgccgagcugccguucaccaucgacaaguga

SEQ ID NO: 20991 - RNA, 1410 nt, Artificial Sequence; identical to SEQ ID NO: 16318
  derived and/or modified CDS sequence (AUadapt) from InfluenzaA__ADF28048__NA

SEQ ID NO: 20992 - RNA, 1410 nt, Artificial Sequence; identical to SEQ ID NO: 16318
  derived and/or modified CDS sequence (AUadapt) from InfluenzaA__ADF28058__NA

SEQ ID NO: 20993 - RNA, 1410 nt, Artificial Sequence
  derived and/or modified CDS sequence (AUadapt) from InfluenzaA__ADF28068__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggucguccagccucugcccggucuccggcugggccaucuacagcaaggacaacuccauccgcaucggcagcaagggggacguguucgugauccgggagcccuucaucuccugcagccaccuggagugccgcaccuucuuccugacccagggcgcccuccugaacgacaagcacuccaacgggaccaucaaggaccggucgcccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugaccggccuggacugcauccgcccgugcuucugggucgagcucauccggggccgccccaaggagaacacgaucuggaccuccgggagcuccaucagcuucugcggcgugaacuccgacaccgucggguggagcuggcccgacggcgccgagcugcccuucaccaucgacaaguga

SEQ ID NO: 20994 - RNA, 1410 nt, Artificial Sequence; identical to SEQ ID NO: 16318
  derived and/or modified CDS sequence (AUadapt) from InfluenzaA__ADF28078__NA

SEQ ID NO: 20995 - RNA, 1410 nt, Artificial Sequence; identical to SEQ ID NO: 16318
  derived and/or modified CDS sequence (AUadapt) from InfluenzaA__ADF28088__NA

SEQ ID NO: 20996 - RNA, 1410 nt, Artificial Sequence; identical to SEQ ID NO: 20602
  derived and/or modified CDS sequence (AUadapt) from InfluenzaA__ADF28110__NA

SEQ ID NO: 20997 - RNA, 1410 nt, Artificial Sequence; identical to SEQ ID NO: 16318
  derived and/or modified CDS sequence (AUadapt) from InfluenzaA__ADF28120__NA

SEQ ID NO: 20998 - RNA, 1410 nt, Artificial Sequence; identical to SEQ ID NO: 16318
  derived and/or modified CDS sequence (AUadapt) from InfluenzaA__ADF29919__NA

SEQ ID NO: 20999 - RNA, 1410 nt, Artificial Sequence; identical to SEQ ID NO: 20277
  derived and/or modified CDS sequence (AUadapt) from InfluenzaA__ADF42692__NA

SEQ ID NO: 21000 - RNA, 1410 nt, Artificial Sequence; identical to SEQ ID NO: 16318
  derived and/or modified CDS sequence (AUadapt) from InfluenzaA__ADF42702__NA

SEQ ID NO: 21001 - RNA, 1410 nt, Artificial Sequence; identical to SEQ ID NO: 20975
  derived and/or modified CDS sequence (AUadapt) from InfluenzaA__ADF42712__NA

SEQ ID NO: 21002 - RNA, 1410 nt, Artificial Sequence; identical to SEQ ID NO: 16318
  derived and/or modified CDS sequence (AUadapt) from InfluenzaA__ADF42722__NA

SEQ ID NO: 21003 - RNA, 1410 nt, Artificial Sequence; identical to SEQ ID NO: 20428
  derived and/or modified CDS sequence (AUadapt) from InfluenzaA__ADF42732__NA

SEQ ID NO: 21004 - RNA, 1410 nt, Artificial Sequence; identical to SEQ ID NO: 16318
  derived and/or modified CDS sequence (AUadapt) from InfluenzaA__ADF42742__NA

SEQ ID NO: 21005 - RNA, 1410 nt, Artificial Sequence; identical to SEQ ID NO: 16274
  derived and/or modified CDS sequence (AUadapt) from InfluenzaA__ADF58339__NA

SEQ ID NO: 21006 - RNA, 1410 nt, Artificial Sequence; identical to SEQ ID NO: 16318
  derived and/or modified CDS sequence (AUadapt) from InfluenzaA__ADF58348__NA

SEQ ID NO: 21007 - RNA, 1410 nt, Artificial Sequence; identical to SEQ ID NO: 16318
  derived and/or modified CDS sequence (AUadapt) from InfluenzaA__ADF58350__NA

SEQ ID NO: 21008 - RNA, 1410 nt, Artificial Sequence; identical to SEQ ID NO: 16318
  derived and/or modified CDS sequence (AUadapt) from InfluenzaA__ADF58352__NA

SEQ ID NO: 21009 - RNA, 1410 nt, Artificial Sequence
  derived and/or modified CDS sequence (AUadapt) from InfluenzaA__ADF80459__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucaccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacaccguguggaccuccgggagcuccaucagcuucugcggcgucaacuccgacacggugggguggagcuggcccgacggcgccgagcugccguucaccaucgacaaguga

SEQ ID NO: 21010 - RNA, 1410 nt, Artificial Sequence
  derived and/or modified CDS sequence (AUadapt) from InfluenzaA__ADF80503__NA
augaaccccaaccagaagaucaucaccaucggcucggugugcaugaccaucgggauggccaaccugauccuccagaucggcaacaucacguccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuacuacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21011 - RNA, 1410 nt, Artificial Sequence
  derived and/or modified CDS sequence (AUadapt) from InfluenzaA__ADF83744__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 21012 - RNA, 1410 nt, Artificial Sequence; identical to SEQ ID NO: 19994
  derived and/or modified CDS sequence (AUadapt) from InfluenzaA__ADF83755__NA

SEQ ID NO: 21013 - RNA, 1410 nt, Artificial Sequence
  derived and/or modified CDS sequence (AUadapt) from InfluenzaA__ADF83766__NA
augaaccccaaccagaagaucaucaccaucggcucggugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacgacaacggcgucuggaucgggcgcaccaagagcaucagcucccggaacggcuucgagaugaucugggaccccaacggcuggaccgggacggacaacaacuucagcaucaagcaggacaucgugggcaucaacgagugguccggguacucgggcuccuucgugcagcacccggagcugaccgggcuggacugcauccgccccugcuucugggucgagcucauccggggccgccccaaggagaacaccaucuggaccagcggcuccagcaucuccuucugcggggugaacagcgacacggucggcugguccuggcccgacggggccgagcugccguucaccaucgacaaguga

SEQ ID NO: 21014 - RNA, 1410 nt, Artificial Sequence; identical to SEQ ID NO: 16318
  derived and/or modified CDS sequence (AUadapt) from InfluenzaA__ADF83776__NA

SEQ ID NO: 21015 - RNA, 1410 nt, Artificial Sequence
  derived and/or modified CDS sequence (AUadapt) from InfluenzaA__ADF83786__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacggggacaccgucggcuggagcuggcccgacggcgccgagcugccguucacgaucgacaaguga

SEQ ID NO: 21016 - RNA, 1410 nt, Artificial Sequence
  derived and/or modified CDS sequence (AUadapt) from InfluenzaA__ADF83796__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucgugcgcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 21017 - RNA, 1410 nt, Artificial Sequence; identical to SEQ ID NO: 16318
  derived and/or modified CDS sequence (AUadapt) from InfluenzaA__ADF83806__NA

SEQ ID NO: 21018 - RNA, 1410 nt, Artificial Sequence; identical to SEQ ID NO: 20653
  derived and/or modified CDS sequence (AUadapt) from InfluenzaA__ADF83816__NA

SEQ ID NO: 21019 - RNA, 1410 nt, Artificial Sequence; identical to SEQ ID NO: 16318
  derived and/or modified CDS sequence (AUadapt) from InfluenzaA__ADF83826__NA

SEQ ID NO: 21020 - RNA, 1410 nt, Artificial Sequence; identical to SEQ ID NO: 16318
  derived and/or modified CDS sequence (AUadapt) from InfluenzaA__ADF83836__NA

SEQ ID NO: 21021 - RNA, 1410 nt, Artificial Sequence; identical to SEQ ID NO: 16318
  derived and/or modified CDS sequence (AUadapt) from InfluenzaA__ADF83846__NA

SEQ ID NO: 21022 - RNA, 1410 nt, Artificial Sequence; identical to SEQ ID NO: 16318
  derived and/or modified CDS sequence (AUadapt) from InfluenzaA__ADF83856__NA

SEQ ID NO: 21023 - RNA, 1410 nt, Artificial Sequence; identical to SEQ ID NO: 20491
  derived and/or modified CDS sequence (AUadapt) from InfluenzaA__ADF83866__NA

SEQ ID NO: 21024 - RNA, 1410 nt, Artificial Sequence; identical to SEQ ID NO: 20921
  derived and/or modified CDS sequence (AUadapt) from InfluenzaA__ADF83876__NA

SEQ ID NO: 21025 - RNA, 1410 nt, Artificial Sequence; identical to SEQ ID NO: 20571
  derived and/or modified CDS sequence (AUadapt) from InfluenzaA__ADF83888__NA

SEQ ID NO: 21026 - RNA, 1410 nt, Artificial Sequence
  derived and/or modified CDS sequence (AUadapt) from InfluenzaA__ADF83898__NA
augaaccccaaccagaagaucaucaccaucggcucggugugcaugaccaucgggauggccaaccugauccuccagaucggcaacaucaucuccaucuggaucagccacccgauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugccccgucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgccguaccgcacgcugauguccugccccaucggcgagguccccagccccuacaacucccgguucgagagcguggccuggagcgcguccgccugccacgacgggaucaacuggcucaccaucggcaucucgggcccggacaacggggccguggccguccugaaguacaacggcaucaucaccgacaccaucaaguccuggcgcaacaacauccugcggacgcaggagagcgagugcgcgugcgugaacggguccugcuucaccgugaugaccgacggccccagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgcccgugggucuccuucaaccagaaccucgaguaccagaucggguacaucugcagcggcaucuucggggacaacccccggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 21027 - RNA, 1410 nt, Artificial Sequence; identical to SEQ ID NO: 16318
  derived and/or modified CDS sequence (AUadapt) from InfluenzaA__ADF83908__NA

SEQ ID NO: 21028 - RNA, 1410 nt, Artificial Sequence; identical to SEQ ID NO: 16318
  derived and/or modified CDS sequence (AUadapt) from InfluenzaA__ADF83918__NA

SEQ ID NO: 21029 - RNA, 1410 nt, Artificial Sequence; identical to SEQ ID NO: 16318
  derived and/or modified CDS sequence (AUadapt) from InfluenzaA__ADF84444__NA

SEQ ID NO: 21030 - RNA, 1410 nt, Artificial Sequence; identical to SEQ ID NO: 16318
  derived and/or modified CDS sequence (AUadapt) from InfluenzaA__ADF84462__NA

SEQ ID NO: 21031 - RNA, 1410 nt, Artificial Sequence
  derived and/or modified CDS sequence (AUadapt) from InfluenzaA__ADF84472__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacgggccguccgacggccaggccagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccgggagcugcggccccguguccagcaacggcgccaacggggugaagggcuucuccuucaaguacgggaacggcgucuggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 21032 - RNA, 1410 nt, Artificial Sequence
  derived and/or modified CDS sequence (AUadapt) from InfluenzaA__ADF84482__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucgccaucaagcaggacaucguggggaucaacgaguggagcggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucagcugguccuggcccgacggggcggagcugccguucaccaucgacaaguga

SEQ ID NO: 21033 - RNA, 1410 nt, Artificial Sequence
  derived and/or modified CDS sequence (AUadapt) from InfluenzaA__ADF84492__NA
augaaccccaaccagaagaucaucaccaucggcucggugugcaugaccaucgggauggccaaccugauccuccagaucggcaacaucaucuccaucuggaucagccacuccauccagcuggggaaccaggaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21034 - RNA, 1410 nt, Artificial Sequence; identical to SEQ ID NO: 20247
  derived and/or modified CDS sequence (AUadapt) from InfluenzaA__ADF85020__NA

SEQ ID NO: 21035 - RNA, 1410 nt, Artificial Sequence; identical to SEQ ID NO: 16318
  derived and/or modified CDS sequence (AUadapt) from InfluenzaA__ADF87155__NA

SEQ ID NO: 21036 - RNA, 1410 nt, Artificial Sequence
  derived and/or modified CDS sequence (AUadapt) from InfluenzaA__ADF87165__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacggugaugaccgacggcccguccgacggccaggccagcuacaagaucuuccgcaucgacaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucgccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgcggagcugccguucaccaucgacaaguga

SEQ ID NO: 21037 - RNA, 1410 nt, Artificial Sequence; identical to SEQ ID NO: 21031
  derived and/or modified CDS sequence (AUadapt) from InfluenzaA__ADF87175__NA

SEQ ID NO: 21038 - RNA, 1410 nt, Artificial Sequence; identical to SEQ ID NO: 16318
  derived and/or modified CDS sequence (AUadapt) from InfluenzaA__ADF87185__NA

SEQ ID NO: 21039 - RNA, 1410 nt, Artificial Sequence; identical to SEQ ID NO: 21031
  derived and/or modified CDS sequence (AUadapt) from InfluenzaA__ADF87195__NA

SEQ ID NO: 21040 - RNA, 1410 nt, Artificial Sequence; identical to SEQ ID NO: 16318
  derived and/or modified CDS sequence (AUadapt) from InfluenzaA__ADF87205__NA

SEQ ID NO: 21041 - RNA, 1410 nt, Artificial Sequence; identical to SEQ ID NO: 16318
  derived and/or modified CDS sequence (AUadapt) from InfluenzaA__ADF87215__NA

SEQ ID NO: 21042 - RNA, 1410 nt, Artificial Sequence
  derived and/or modified CDS sequence (AUadapt) from InfluenzaA__ADF87235__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21043 - RNA, 1410 nt, Artificial Sequence; identical to SEQ ID NO: 21031
  derived and/or modified CDS sequence (AUadapt) from InfluenzaA__ADF87245__NA

SEQ ID NO: 21044 - RNA, 1410 nt, Artificial Sequence; identical to SEQ ID NO: 21031
  derived and/or modified CDS sequence (AUadapt) from InfluenzaA__ADF87265__NA

SEQ ID NO: 21045 - RNA, 1410 nt, Artificial Sequence
  derived and/or modified CDS sequence (AUadapt) from InfluenzaA__ADF87285__NA
augaaccccaaccagaagaucaucaccaucggcucggugugcauguccaucgggauggccaaccugauccuccagaucggcaacaucaucagcaucuggaucucccacagcauccagcuggggaacaagaaccagaucgagaccugcaaccaguccgucaucacguacgagaacaacaccugggugaaccagaccuacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggucgcccuaccgcacccugauguccugcccgaucggcgagguccccagccccuacaacagccgguucgaguccguggccuggagcgcguccgccugccacgacgggaucaacuggcucacgaucggcaucagcggccccgacaacggggccguggccguccugaaguacaacggcaucaucaccgacaccaucaaguccuggcgcaacaacauccugcggacccaggagucggagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaagggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaugaacgaguggucgggcuacuccgggagcuucgugcagcacccggagcugaccggccuggacugcauccgccccugcuucugggucgagcucauccggggccgccccaaggagaacaccaucuggacguccgggagcuccaucagcuucugcggcgugaacuccgacaccgucggguggagcuggcccgacggcgccgagcugccguucaccaucgacaaguga

SEQ ID NO: 21046 - RNA, 1410 nt, Artificial Sequence; identical to SEQ ID NO: 16318
  derived and/or modified CDS sequence (AUadapt) from InfluenzaA__ADF87295__NA

SEQ ID NO: 21047 - RNA, 1410 nt, Artificial Sequence; identical to SEQ ID NO: 16318
  derived and/or modified CDS sequence (AUadapt) from InfluenzaA__ADF87305__NA

SEQ ID NO: 21048 - RNA, 1410 nt, Artificial Sequence; identical to SEQ ID NO: 16318
  derived and/or modified CDS sequence (AUadapt) from InfluenzaA__ADF87334__NA

SEQ ID NO: 21049 - RNA, 1410 nt, Artificial Sequence; identical to SEQ ID NO: 16318
  derived and/or modified CDS sequence (AUadapt) from InfluenzaA__ADF87344__NA

SEQ ID NO: 21050 - RNA, 1410 nt, Artificial Sequence
  derived and/or modified CDS sequence (AUadapt) from InfluenzaA__ADF87354__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacuacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21051 - RNA, 1410 nt, Artificial Sequence; identical to SEQ ID NO: 19723
  derived and/or modified CDS sequence (AUadapt) from InfluenzaA__ADF87364__NA

SEQ ID NO: 21052 - RNA, 1410 nt, Artificial Sequence; identical to SEQ ID NO: 16318
  derived and/or modified CDS sequence (AUadapt) from InfluenzaA__ADF87374__NA

SEQ ID NO: 21053 - RNA, 1410 nt, Artificial Sequence
  derived and/or modified CDS sequence (AUadapt) from InfluenzaA__ADF87384__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21054 - RNA, 1410 nt, Artificial Sequence; identical to SEQ ID NO: 16318
  derived and/or modified CDS sequence (AUadapt) from InfluenzaA__ADF97251__NA

SEQ ID NO: 21055 - RNA, 1410 nt, Artificial Sequence; identical to SEQ ID NO: 20383
  derived and/or modified CDS sequence (AUadapt) from InfluenzaA__ADF97252__NA

SEQ ID NO: 21056 - RNA, 1410 nt, Artificial Sequence; identical to SEQ ID NO: 16318
  derived and/or modified CDS sequence (AUadapt) from InfluenzaA__ADF97253__NA

SEQ ID NO: 21057 - RNA, 1410 nt, Artificial Sequence; identical to SEQ ID NO: 16318
  derived and/or modified CDS sequence (AUadapt) from InfluenzaA__ADF97254__NA

SEQ ID NO: 21058 - RNA, 1410 nt, Artificial Sequence
  derived and/or modified CDS sequence (AUadapt) from InfluenzaA__ADF97255__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaaccacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21059 - RNA, 1410 nt, Artificial Sequence; identical to SEQ ID NO: 16318
  derived and/or modified CDS sequence (AUadapt) from InfluenzaA__ADF97256__NA

SEQ ID NO: 21060 - RNA, 1410 nt, Artificial Sequence; identical to SEQ ID NO: 16318
  derived and/or modified CDS sequence (AUadapt) from InfluenzaA__ADF97257__NA

SEQ ID NO: 21061 - RNA, 1410 nt, Artificial Sequence; identical to SEQ ID NO: 19494
  derived and/or modified CDS sequence (AUadapt) from InfluenzaA__ADF97837__NA

SEQ ID NO: 21062 - RNA, 1410 nt, Artificial Sequence; identical to SEQ ID NO: 16318
  derived and/or modified CDS sequence (AUadapt) from InfluenzaA__ADG08120__NA

SEQ ID NO: 21063 - RNA, 1350 nt, Artificial Sequence
  derived and/or modified CDS sequence (AUadapt) from InfluenzaA__ADG21408__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgaaaaggccguggccagcgucacccuggcgggcaaccucucccugugccccgugagcgggugggccguguacuccaaggacaauagcauccgcaucggcucccggggcgacgucuucgugauccgcgagcccuucaucagcugcucccaccuggagugccggaccuuuuuccucacgcagggggcccugcugaacgacaagcacagcaacggcaccgugaaggaccgcagcccccaccggacccucauguccuguccggucggggaggcccccucccccuacaacagccgcuucgaauccguggccuggagcgcgagcgccugccacgacggcaccuccuggcugacgaucgggaucaguggccccgacaacggcgccguggccguccugaaguacaacgggaucaucaccgacaccaucaaguccuggcggaacaacaucaugcgcacccaggagagcgagugugcgugcgugaacggcuccugcuucacggugaugaccgacgggccgagcuccggccaggccagcuacaagaucuucaaaauggagaagggcaaggucgugaaguccguggagcucgaugcccccaacuaccacuacgaggagugcagcugcuaccccgacgccggggagaucacgugugucugccgggacaacuggcacggcuccaaccgccccugggugagcuucaaccaaaaucuggaguaccagaucggguacaucugcuccggcguguucggggacaacccgcggcccaacgacggcaccggcagcugugggcccgucuuccccaacggcgccuacggggugaagggcuucuccuucaaguacgggaacggcguguggaucggccgcaccaagagcaccaacucccggaguggguucgagaugaucugggacccgaacggcuggaccgggaccgacuccagcuucagcgucaagcaagacaucguggcgaucacggauugguccggcuacagcggguccuucguccagcaccccgagcugaccggccucgacugcauccgccccugcuucuggguggagcugauccggggccgccccaaggagagcaccaucuggaccuccgggaguuccaucagcuucugcggcgugaacggggacacggucuccuggagcuggccggacggcgccgagcugcccuucaccaucgacaaguga

SEQ ID NO: 21064 - RNA, 1350 nt, Artificial Sequence; identical to SEQ ID NO: 19425
  derived and/or modified CDS sequence (AUadapt) from InfluenzaA__ADG21409__NA

SEQ ID NO: 21065 - RNA, 1350 nt, Artificial Sequence; identical to SEQ ID NO: 19425
  derived and/or modified CDS sequence (AUadapt) from InfluenzaA__ADG21415__NA

SEQ ID NO: 21066 - RNA, 1350 nt, Artificial Sequence; identical to SEQ ID NO: 19425
  derived and/or modified CDS sequence (AUadapt) from InfluenzaA__ADG21417__NA

SEQ ID NO: 21067 - RNA, 1350 nt, Artificial Sequence
  derived and/or modified CDS sequence (AUadapt) from InfluenzaA__ADG21419__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgaguccaucagcaacacgaaguuccugaccgagaaggccguggccuccgucacccuggcgggcaacagcucccucugcccgaucagcgggugggccguguacuccaaggauaacagcauccgcaucggcucccggggcgacguguucgucauccgcgagcccuucaucagcugcucccaccuggaaugccggaccuuuuuccugacgcagggggcccuccugaacgacaagcacagcaacggcaccgugaaggaccgcagcccccaucggacccugauguccugccccgugggggaggccccgucccccuacaacagccgcuucgagagcgucgccugguccgcgagcgccugccacgauggcaccuccuggcucacgaucgggaucagcggccccgacaacggcgccguggccgugcugaaguacaacgggaucaucaccgacaccaucaaguccuggcggaacaacaucaugcgcacccaggagagcgagugugcgugcgucaacggcuccugcuucacggugaugaccgacgggcccagcuccggccaggccagcuacaagaucuucaaaauggagaagggcaagguggucaaguccguggagcuggaugccccgaacuaccacuacgaggagugcagcugcuaccccgaugccggggagaucacgugcgugugccgggacaacuggcacggcuccaaccgccccugggucagcuucaaccagaaucucgaguaccagaucggguacaucugcuccggcguguucggggacaacccccggccgaacgacggcaccggcagcugugggcccguguuccccaacggcgccuacggggucaagggcuucuccuucaaauacgggaacggcguguggaucggccgcaccaagagcaccaauucccggagcggguucgagaugaucugggaccccaacggcuggaccgggaccgacagcuccuucagcgugaagcaggacaucgucgcgaucacggauugguccggcuacagcggguccuucgugcagcacccggagcugaccggccuggacugcauccgccccugcuucugggucgagcucauccggggccgccccaaggagagcaccaucuggaccuccgggaguuccaucagcuucugcggcgugaacggggacacgguguccuggagcuggcccgacggcgccgagcugccguucaccaucgacaaguga

SEQ ID NO: 21068 - RNA, 1350 nt, Artificial Sequence
  derived and/or modified CDS sequence (AUadapt) from InfluenzaA__ADG21423__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgaaaaggccguggccagcgucacccuggcgggcaacuccagccucugccccaucuccgggugggccguguacagcaaggauaacuccauccgcaucggcagccggggcgacguguucgucauccgcgagcccuucaucuccugcagccaccuggagugucggaccuucuuccugacgcagggggcccuccugaacgacaagcacuccaacggcaccgugaaggaccgcagcccccaccggacccugauguccuguccggugggggaggcccccagccccuacaacucccgcuucgaaagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaggaguccgagugugcgugcgucaacggcagcugcuucacggugaugaccgacgggccguccagcggccaggccuccuacaagaucuucaaaauggagaagggcaagguggucaagaguguggagcuggacgcccccaacuaccacuacgaggagugcuccugcuaccccgacgccggggagaucacgugugugugccgggacagcuggcacggcuccaaccgccccugggucagcuucaaccaaaaucucgaguaccagaucggguacaucugcuccggcguguucggggacaacccgcggcccaacgacggcaccggcagcugugggcccguguuccccaacggcgccuacggggucaagggcuucuccuucaaguacgggaacggcguguggaucggccgcaccaagagcaccaacucccggaguggguucgagaugaucugggacccgaacggcuggaccgggaccgacagcuccuucagcgugaagcaagacaucgucgcgaucacggauugguccggcuacagcggguccuucgugcagcaccccgagcugaccggccuggacugcauccgccccugcuucugggucgagcucauccggggccgccccaaggagagcaccaucuggaccuccgggaguuccaucagcuucugcggcgugaacggggacacgguguccuggagcuggccggacggcgccgagcugcccuucaccaucgacaaguga

SEQ ID NO: 21069 - RNA, 1350 nt, Artificial Sequence
  derived and/or modified CDS sequence (AUadapt) from InfluenzaA__ADG21424__NA
augaaucccaaccaaaagaucaucaccaucggcagcaucugcauggugaucgggaucgccucccugaugcuccagaucggcaacaugaucagcaucugggucucccacagcauccagaccgggaaccagugucaggacgaguccaucagcaacacgaaguuccugaccgagaaggccguggcguccgugacccuggccggcaacagcucccucugcccgaucagcgggugggccgucuauuccaaggacaacagcauccgcaucggcuccaagggcgacguguucgugauccgggagcccuucaucagcugcucccaucuggagugccgcaccuucuuccugacgcagggggcccuccugaacgacaagcacagcaacggcaccgucaaggaucggagcccccaccgcacccugauguccugccccgugggggaggccccgucccccuacaacagccgguucgagagcguggcgugguccgccagugccugccacgacggcaccuccuggcucacgaucgggaucagcggccccgacaacggcgccgucgcggugcugaaguacaacgggaucaucaccgauaccaucaaguccuggcgcaacaacaucaugcggacccaggagagcgagugcgccugcgugaacggcuccugcuucacggucaugaccgaugggcccagcuccggccaggccagcuacaagaucuucaaaauggagaagggcaagguggugaaguccgucgagcuggacgccccgaacuaccacuaugaggagugcagcugcuaccccgacgccggggagaucacgugcgugugccgcgacaauuggcacggcuccaaccggcccugggugagcuucaaccagaaccucgaguaccagaucggguacaucuguuccggcgucuucggggacaacccccgcccgaacgacggcaccggcagcugcgggcccguguuccccaauggcgcguacggggugaagggcuucuccuucaaguacgggaacggcgucuggaucggccggaccaagagcaccaacucccgcagcggguuugagaugaucugggaccccaacggcuggaccgggaccgacagcuccuucagcgugaagcaggacaucguggccaucacggacugguccggcuauagcggguccuucguccagcacccggagcugaccggccuggacugcauccggcccugcuucuggguggagcucauccgcggccggcccaaggagagcaccaucuggaccuccgggaguuccaucagcuucugcggcgucaacggggacacgguguccuggagcuggcccgacggcgccgagcugccguucaccaucgacaaguga

SEQ ID NO: 21070 - RNA, 1350 nt, Artificial Sequence
  derived and/or modified CDS sequence (AUadapt) from InfluenzaA__ADG21426__NA
augaaucccaaccaaaagaucaucaccaucggcagcaucugcauggugaucgggaucgucucccugaugcuccagaucggcaacaugaucagcaucugggugucccacagcauccagaccgagaaccagugucaggacgagccgaucuccaacacgaaauuccugaccgagaaggccguggccagcgucacccuggcggggaacuccagccucugccccaucuccggcugggccguguacagcaaggauaacuccauccgcaucgggagccggggcgacguguucgucauccgcgagcccuucaucuccugcagccaccuggagugucggaccuucuuccugacgcagggcgcccuccugaacgacaagcacuccaacgggaccgugaaggaccgcagcccccaccggacccugauguccuguccggugggcgaagcccccagccccuacaacucccgcuucgagagcgucgccuggagcgcguccgccugccacgacgggaccaguuggcucacgaucggcaucuccgggcccgacaacggcgccguggccgugcugaaguacaacggcaucaucaccgacaccaucaagagcuggcggaacaacaucaugcgcacccaggaguccgagugugcgugcgucaacgggagcugcuucacggugaugaccgacggcccguccagcgggcaggccuccuacaaaaucuucaagauggagaagggcaagguggucaagaguguggagcuggacgcccccaacuaccacuacgaggagugcuccugcuaccccgacgccggcgaaaucacgugugugugccgggacaacuggcacgggagcaaccgccccugggucuccuucaaccagaaucucgaguaccagaucggcuacaucugcagcgggguguucggcgacaacccgcggcccaacgacgggaccggcuccuguggccccguguuccccaacggggccuacggcgucaagggguucagcuucaaguacggcaacgggguguggaucggccgcaccaaguccaccaacagucgguccggcuucgagaugaucugggacccgaacggguggaccggcaccgacagcagcuucuccgugcgccaagacaucgucgcgaucacggauuggagcggguacuccggcagcuucgugcagcaccccgagcugaccgggcuggacugcauccggcccugcuucugggucgagcucauccgcggccggcccaaggaguccaccaucuggaccaguggcuccagcaucuccuucugcggggugaacggcgacacggugagcugguccuggccggacggggccgagcugcccuucaccaucgacaaguga

SEQ ID NO: 21071 - RNA, 1350 nt, Artificial Sequence
  derived and/or modified CDS sequence (AUadapt) from InfluenzaA__ADG21428__NA
augaaucccaaccaaaagaucaucaccaucggcagcaucugcauggugaucgggaucgucucccugaugcuccagaucggcaacaugaucagcaucugggugucccacccgauccagaccgggaaccagugccaggauaagcccaucagcaacacgaaguuccugaccgaaaaggccguggccuccgucacccuggcgggcaacagcucccucugccccaucagcgggugggccguguacuccaaggacaauagcauccgcaucggcucccggggcgacguguucgucauccgcgagcccuucaucagcugcucccaccuggagugccggaccuuuuuccugacgcagggggcccuccugaacgacaagcacagcaacggcaccgugaaggaccgcuccccgcaccggacccugaugagcugucccgugggggaggcccccucccccuacaacagccgcuucgaauccgucgccuggagcgcgagcgccugccacgauggcaccuccuggcucacgaucgggaucagcggcccggacaacggcgccguggccgugcugaaguacaacgggaucaucaccgacaccaucaaguccuggcggaacagcaucaugcgcacccaggaguccgagugcgcgugugucaacggcagcugcuucacggugaugaccgacgggcccuccagcggccaggccuccuacaagaucuucaaaauggagaagggcaagguggucaagagcguggagcuggaugcccccaacuaccacuacgaggagugcuccugcuaccccgacgccggggagaucacgugugugugccgggacaacuggcacggcagcaaccgcccgugggucuccuucaaccaaaaccucgaguaucagaucggguacaucugcagcggcguguucggggacaacccccggcccaacgacggcaccggcuccugugggcccguguucccgaacggcgccuacggggucaagggcuucagcuucaaguacgggaacggcguguggaucggccgcaccaaguccaccaacagucgguccggguucgagaugaucugggaccccaacggcuggaccgggaccgacagcagcuucuccgugaagcaagacaucgucgcgaucacggauuggagcggcuacuccgggagcuucgugcagcaccccgagcugaccggccuggacugcauccgccccugcuucugggucgagcucauccggggccgcccgaaggaguccaccaucuggaccaguggguccagcaucuccuucugcggcgugaacggggacacggugagcugguccuggcccgacggcgccgagcugcccuucaccaucgacaaguga

SEQ ID NO: 21072 - RNA, 1350 nt, Artificial Sequence; identical to SEQ ID NO: 19425
  derived and/or modified CDS sequence (AUadapt) from InfluenzaA__ADG21430__NA

SEQ ID NO: 21073 - RNA, 1350 nt, Artificial Sequence
  derived and/or modified CDS sequence (AUadapt) from InfluenzaA__ADG21432__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaauuccugaccgagaaggccguggccagcgucacccuggcgggcaacuccagccucugccccaucuccgggugggccguguacagcaaggauaacuccauccgcaucggcagccggggcgacguguucgucauccgcgagcccuucaucuccugcagccaccuggagugucggaccuucuuccugacgcagggggcccuccugaacgacaaacacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaggaauccgagugugcgugcgucaacggcagcugcuucacggugaugaccgacgggccguccagcggccaggccuccuacaagaucuucaagauggagaagggcaaaguggucaagaguguggagcuggacgcccccaacuaccacuacgaggagugcuccugcuaccccgacgccggggagaucacgugugugugccgggacaacuggcacggcagcaaccgccccugggucuccuucaaccagaaucucgaauaccagaucggguacaucugcagcggcguguucggggacaacccgcggcccaacgacggcaccggcuccugugggcccguguuccccaacggcgccuacggggucaagggcuucagcuuccgcuacgggaacggcguguggaucggccggaccaaguccaccaacagucgcuccggguucgagaugaucugggacccgaacggcuggaccgggaccgacagcagcuucuccgugaagcaggacaucgucgcgaucacggauuggagcggcuacuccgggagcuucgugcaacaccccgagcugaccggccuggacugcauccggcccugcuucugggucgagcucauccgcggccggcccaaggaguccaccaucuggaccaguggguccagcaucuccuucugcggcgugaacggggacacggugagcugguccuggccggacggcgccgagcugcccuucaccaucgacaaguga

SEQ ID NO: 21074 - RNA, 1350 nt, Artificial Sequence
  derived and/or modified CDS sequence (AUadapt) from InfluenzaA__ADG21438__NA
augaaucccaaccaaaagaucaucaccaucggcagcaucugcauggugaucgggaucgucucccugaugcuccagaucggcaacaugaucagcaucuggaucucccacagcauccagaccgggaaccagugucaggacgagccgaucuccaacacgaaguuccugaccgagaaggccguggccagcgugacccuggcgggcaacuccagccucugccccaucuccgggugggccgucuacagcaaagauaacuccauccgcaucggcagccggggcgacguguucgugauccgcgagcccuucaucuccugcagccaccuggagugucggaccuucuuccugacgcagggggcccuccugaacgacaagcacuccaacggcaccgucaaggaccgcagcccccaccggacccugauguccuguccggugggggaggcccccagccccuacaacucccgcuucgagagcguggccuggagcgcguccgccugccacgacggcaccaguuggcucacgaucgggaucuccggccccgacaacggcgccgucgccgugcugaaguacaacgggaucaucaccgacaccaucaagagcuggcggaacaacaucaugcgcacccaagaguccgagugugcgugcgugaacggcagcugcuucacggucaugaccgacgggccguccagcggccaggccuccuacaagaucuucaagauggagaagggcaagguggucaagaguguggaacuggacgcccccaacuaccacuacgaggagugcuccugcuaccccgacgccggggagaucacgugugugugccgggacaacuggcacggcagcaaccgccccuggguguccuucaaccagaaucucgaguaccagaucggguacaucugcagcggcgucuucggggacaacccgcggcccaacgacggcaccggcuccugugggcccguguuccccaacggcgccuacggggugaagggcuucagcuucaaguacggguccggcgucuggaucggccgcaccaagagcaccaacucccggaguggguucgaaaugaucugggacccgaacggcuggaccgggaccgacagcuccuucagcgugaagcaggacaucguggcgaucacggauugguccggcuacagcggguccuucguccagcaccccgagcugaccggccuggacugcauccgccccugcuucuggguggagcucauccggggccgccccaaggagagcaccaucuggaccuccgggaguuccaucagcuucugcggcgucaacggggacacgguguccuggagcuggccggacggcgccgagcugcccuucaccaucgacaaguga

SEQ ID NO: 21075 - RNA, 1350 nt, Artificial Sequence
  derived and/or modified CDS sequence (AUadapt) from InfluenzaA__ADG21440__NA
augaaucccaaccaaaagaucaucaccaucggcagcaucugcauggugaucgggaucgccucccugaugcuccagaucggcaacaugaucagcaucugggucucccacagcauccagaccgggaaccagugucaggacgaguccaucagcaacacgaaguuccugaccgagaaggccguggcguccgugacccuggccggcaacagcucccucugcccgaucagcgggugggccgucuauuccaaggacaacagcauccgcaucggcucccggggcgacguguucgugauccgcgagcccuucaucagcugcucccaucuggaaugccggaccuucuuccugacgcagggggcccuccugaacgacaagcacagcaacggcaccgucaaggaucgcagcccccaccggacccugauguccugccccgugggggaggccccgucccccuacaacagccgcuucgagagcguggcgugguccgccagugccugccacgacggcaccuccuggcucacgaucgggaucagcggccccgacaacggcgccgucgcggugcugaaguacaacgggaucaucaccgauaccaucaaguccuggcggaacaacaucaugcgcacccaggagagcgagugcgccugcgugaacggcuccugcuucacggucaugaccgaugggcccagcuccggccaggccagcuacaagaucuucaaaauggagaagggcaagguggugaaguccgucgagcuggacgccccgaacuaccacuaugaggagugcagcugcuaccccgacgccggggagaucacgugcgugugccgggacaauuggcacggcuccaaccgccccugggugagcuucaaccagaaccucgaguaccagaucggguacaucuguuccggcgucuucggggacaacccccggccgaacgacggcaccggcagcugcgggcccguguuccccaauggcgcguacggggugaagggcuucuccuucaaauacgggaacggcgucuggaucggccgcaccaagagcaccaacucccggagcggguuugagaugaucugggaccccaacggcuggaccgggaccgacagcuccuucagcgugaagcaggacaucguggccaucacggacugguccggcuauagcggguccuucguccagcacccggagcugaccggccuggacugcauccgccccugcuucuggguggagcucauccggggccgccccaaggagagcaccaucuggaccuccgggaguuccaucagcuucugcggcgucaacggggacacgguguccuggagcuggcccgacggcgccgagcugccguucaccaucgacaaguga

SEQ ID NO: 21076 - RNA, 1350 nt, Artificial Sequence; identical to SEQ ID NO: 19425
  derived and/or modified CDS sequence (AUadapt) from InfluenzaA__ADG21442__NA

SEQ ID NO: 21077 - RNA, 1350 nt, Artificial Sequence
  derived and/or modified CDS sequence (AUadapt) from InfluenzaA__ADG21444__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgaguccaucagcaacacgaaguuccugaccgagaaggccgugaccuccgucacccuggccggcaacagcucccucugcccgaucagcgggugggcgguguacuccaaggauaacagcauccgcaucggcucccggggcgacguguucgucauccgcgagcccuucaucagcugcucccaccuggagugccggacguuuuuccugacccagggggcccuccugaacgacaagcacagcaacggcaccgugaaggaccgcagcccccaucggacccugauguccugccccgugggggaggccccgucccccuacaacagccgcuucgagagcgucgccugguccgccagcgcgugccacgauggcacguccuggcucaccaucgggaucagcggccccgacaacggcgccguggccgugcugaaguacaacgggaucaucaccgacaccaucaaguccuggcggaacaacaucaugcgcacgcaggagagcgagugugccugcgucaacggcuccugcuucaccgugaugaccgacgggcccagcuccggccaggcgagcuacaagaucuucaaaauggagaagggcaagguggucaaguccguggagcuggaugccccgaacuaccacuacgaggagugcagcugcuaccccgaugccggggagaucacgugcgugugccgggacaacuggcacggcuccaaccgccccuggaucagcuucaaccagaaucucgaguaccagaucggguacaucugcuccggcgucuucggggacaacccccggccgaacgacggcaccggcagcugugggcccguguuccccaacggcgccuacggggugaagggcuucuccuucaaguacgggaacggcgucuggaucggccgcaccaagagcaccaauucccggagcggguucgagaugaucugggaccccaacggcuggaccgggacggacagcuccuucagcgugaagcaggacaucguggccaucaccgauugguccggcuacagcggguccuucguccagcacccggagcugaccggccuggacugcauccgccccugcuucuggguggagcucauccggggccgccccaaggagagcaccaucuggacguccgggaguuccaucagcuucugcggcgucaacggggacaccguguccuggagcuggcccgacggcgcggagcugccguucaccaucgacaaguga

SEQ ID NO: 21078 - RNA, 1350 nt, Artificial Sequence; identical to SEQ ID NO: 19425
  derived and/or modified CDS sequence (AUadapt) from InfluenzaA__ADG21446__NA

SEQ ID NO: 21079 - RNA, 1350 nt, Artificial Sequence
  derived and/or modified CDS sequence (AUadapt) from InfluenzaA__ADG21448__NA
augaaucccaaccaaaagaucaucaccaucggcagcaucugcauggugaucgggaucgucucccugaugcuccagaucggcaacaugaucagcaucugggugucccacagcauccagaccgggaaccagugucaggacgagccgaucuccaacacgaaguuccugaccgagaaggccguggccagcgucacccuggcgggcaacuccagccucugccccaucuccgggugggccguguacagcaaggauaacuccauccgcaucggcagccggggcgacguguucgucauccgcgagcccuucaucuccugcagccaccuggaaugucggaccuucuuccugacgcagggggcccuccugaacgacaagcacuccaacggcaccgugaaggaccgcagcccccaccggacccugauguccuguccggugggggaggcccccagccccuacaacucccgcuucgagagcgucgccuggagcgcguccgccugccacgacggcaccaguuggcucacgaucgggaucuccggccccgacaacggcgccguggccgugcugaaguacaacgggaucaucaccgacaccaucaagagcuggcggaacaacaucaugcgcacccaggaguccgagugugcgugcgucaacggcagcugcuucacggugaugaccgacgggccguccagcggccaggccuccuacaagaucuucaaaauggagaagggcaagguggucaagaguguggagcuggacgcccccaacuaccacuacgaggagugcuccugcuaccccgacgccggggagaucacgugugugugccgggacaacuggcacggcagcaaccgccccuggaucuccuucaaccagaaucucgaguaccagaucggguacaucugcagcggcgucuucggggacaacccgcggcccaacgacggcaccggcuccugugggcccguguuccccaacggcgccuacggggugaagggcuucagcuucaaauacgggaacggcgucuggaucggccgcaccaaguccaccaacagucgguccggguucgagaugaucugggacccgaacggcuggaccgggaccgacagcagcuucuccgugaagcaggacaucguggcgaucacggauuggagcggcuacuccgggagcuucguccagcaccccgagcugaccggccuggacugcauccgccccugcuucuggguggagcucauccggggccgccccaaggaguccaccaucuggaccaguggguccagcaucuccuucugcggcgucaacggggacacggugagcugguccuggccggacggcgccgagcugcccuucaccaucgacaaguga

SEQ ID NO: 21080 - RNA, 1350 nt, Artificial Sequence; identical to SEQ ID NO: 21079
  derived and/or modified CDS sequence (AUadapt) from InfluenzaA__ADG21450__NA

SEQ ID NO: 21081 - RNA, 1410 nt, Artificial Sequence; identical to SEQ ID NO: 16318
  derived and/or modified CDS sequence (AUadapt) from InfluenzaA__ADG27797__NA

SEQ ID NO: 21082 - RNA, 1410 nt, Artificial Sequence
  derived and/or modified CDS sequence (AUadapt) from InfluenzaA__ADG27983__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaaccaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccauggggugguccuggcccgacggcgccgagcugccguucacgaucgacaaguga

SEQ ID NO: 21083 - RNA, 1410 nt, Artificial Sequence; identical to SEQ ID NO: 16318
  derived and/or modified CDS sequence (AUadapt) from InfluenzaA__ADG27989__NA

SEQ ID NO: 21084 - RNA, 1410 nt, Artificial Sequence; identical to SEQ ID NO: 21082
  derived and/or modified CDS sequence (AUadapt) from InfluenzaA__ADG27998__NA

SEQ ID NO: 21085 - RNA, 1410 nt, Artificial Sequence; identical to SEQ ID NO: 19494
  derived and/or modified CDS sequence (AUadapt) from InfluenzaA__ADG28013__NA

SEQ ID NO: 21086 - RNA, 1410 nt, Artificial Sequence; identical to SEQ ID NO: 16318
  derived and/or modified CDS sequence (AUadapt) from InfluenzaA__ADG42086__NA

SEQ ID NO: 21087 - RNA, 1410 nt, Artificial Sequence; identical to SEQ ID NO: 16318
  derived and/or modified CDS sequence (AUadapt) from InfluenzaA__ADG42096__NA

SEQ ID NO: 21088 - RNA, 1410 nt, Artificial Sequence; identical to SEQ ID NO: 20717
  derived and/or modified CDS sequence (AUadapt) from InfluenzaA__ADG42106__NA

SEQ ID NO: 21089 - RNA, 1410 nt, Artificial Sequence; identical to SEQ ID NO: 16318
  derived and/or modified CDS sequence (AUadapt) from InfluenzaA__ADG42116__NA

SEQ ID NO: 21090 - RNA, 1410 nt, Artificial Sequence; identical to SEQ ID NO: 16318
  derived and/or modified CDS sequence (AUadapt) from InfluenzaA__ADG42126__NA

SEQ ID NO: 21091 - RNA, 1410 nt, Artificial Sequence; identical to SEQ ID NO: 16318
  derived and/or modified CDS sequence (AUadapt) from InfluenzaA__ADG42136__NA

SEQ ID NO: 21092 - RNA, 1410 nt, Artificial Sequence; identical to SEQ ID NO: 19723
  derived and/or modified CDS sequence (AUadapt) from InfluenzaA__ADG42146__NA

SEQ ID NO: 21093 - RNA, 1410 nt, Artificial Sequence; identical to SEQ ID NO: 16318
  derived and/or modified CDS sequence (AUadapt) from InfluenzaA__ADG42156__NA

SEQ ID NO: 21094 - RNA, 1410 nt, Artificial Sequence; identical to SEQ ID NO: 16318
  derived and/or modified CDS sequence (AUadapt) from InfluenzaA__ADG42166__NA

SEQ ID NO: 21095 - RNA, 1410 nt, Artificial Sequence; identical to SEQ ID NO: 16318
  derived and/or modified CDS sequence (AUadapt) from InfluenzaA__ADG42186__NA

SEQ ID NO: 21096 - RNA, 1410 nt, Artificial Sequence; identical to SEQ ID NO: 21031
  derived and/or modified CDS sequence (AUadapt) from InfluenzaA__ADG42196__NA

SEQ ID NO: 21097 - RNA, 1410 nt, Artificial Sequence
  derived and/or modified CDS sequence (AUadapt) from InfluenzaA__ADG42206__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcaagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21098 - RNA, 1410 nt, Artificial Sequence; identical to SEQ ID NO: 16318
  derived and/or modified CDS sequence (AUadapt) from InfluenzaA__ADG42216__NA

SEQ ID NO: 21099 - RNA, 1410 nt, Artificial Sequence; identical to SEQ ID NO: 20491
  derived and/or modified CDS sequence (AUadapt) from InfluenzaA__ADG42226__NA

SEQ ID NO: 21100 - RNA, 1410 nt, Artificial Sequence; identical to SEQ ID NO: 16318
  derived and/or modified CDS sequence (AUadapt) from InfluenzaA__ADG42236__NA

SEQ ID NO: 21101 - RNA, 1410 nt, Artificial Sequence; identical to SEQ ID NO: 16318
  derived and/or modified CDS sequence (AUadapt) from InfluenzaA__ADG42246__NA

SEQ ID NO: 21102 - RNA, 1410 nt, Artificial Sequence; identical to SEQ ID NO: 16318
  derived and/or modified CDS sequence (AUadapt) from InfluenzaA__ADG42256__NA

SEQ ID NO: 21103 - RNA, 1410 nt, Artificial Sequence; identical to SEQ ID NO: 16318
  derived and/or modified CDS sequence (AUadapt) from InfluenzaA__ADG42276__NA

SEQ ID NO: 21104 - RNA, 1410 nt, Artificial Sequence
  derived and/or modified CDS sequence (AUadapt) from InfluenzaA__ADG42296__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcgggcgcaggaguccgagugcgccugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 21105 - RNA, 1410 nt, Artificial Sequence; identical to SEQ ID NO: 16318
  derived and/or modified CDS sequence (AUadapt) from InfluenzaA__ADG42306__NA

SEQ ID NO: 21106 - RNA, 1410 nt, Artificial Sequence; identical to SEQ ID NO: 16318
  derived and/or modified CDS sequence (AUadapt) from InfluenzaA__ADG42316__NA

SEQ ID NO: 21107 - RNA, 1410 nt, Artificial Sequence; identical to SEQ ID NO: 16318
  derived and/or modified CDS sequence (AUadapt) from InfluenzaA__ADG42326__NA

SEQ ID NO: 21108 - RNA, 1410 nt, Artificial Sequence
  derived and/or modified CDS sequence (AUadapt) from InfluenzaA__ADG42336__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaaguucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21109 - RNA, 1410 nt, Artificial Sequence; identical to SEQ ID NO: 20602
  derived and/or modified CDS sequence (AUadapt) from InfluenzaA__ADG42346__NA

SEQ ID NO: 21110 - RNA, 1410 nt, Artificial Sequence; identical to SEQ ID NO: 20317
  derived and/or modified CDS sequence (AUadapt) from InfluenzaA__ADG42356__NA

SEQ ID NO: 21111 - RNA, 1410 nt, Artificial Sequence
  derived and/or modified CDS sequence (AUadapt) from InfluenzaA__ADG42366__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccuggaucucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaaguucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21112 - RNA, 1410 nt, Artificial Sequence; identical to SEQ ID NO: 16318
  derived and/or modified CDS sequence (AUadapt) from InfluenzaA__ADG42376__NA

SEQ ID NO: 21113 - RNA, 1410 nt, Artificial Sequence
  derived and/or modified CDS sequence (AUadapt) from InfluenzaA__ADG42386__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcucgcgguccggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21114 - RNA, 1410 nt, Artificial Sequence; identical to SEQ ID NO: 21097
  derived and/or modified CDS sequence (AUadapt) from InfluenzaA__ADG42396__NA

SEQ ID NO: 21115 - RNA, 1410 nt, Artificial Sequence
  derived and/or modified CDS sequence (AUadapt) from InfluenzaA__ADG42406__NA
augaaccccaaccagaagaucaucaccaucggcucggugugcaugaccaucgggauggccaaccugauccuccagaucggcaacauccuguccacguggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaagggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21116 - RNA, 1410 nt, Artificial Sequence; identical to SEQ ID NO: 20317
  derived and/or modified CDS sequence (AUadapt) from InfluenzaA__ADG42426__NA

SEQ ID NO: 21117 - RNA, 1410 nt, Artificial Sequence; identical to SEQ ID NO: 16318
  derived and/or modified CDS sequence (AUadapt) from InfluenzaA__ADG42436__NA

SEQ ID NO: 21118 - RNA, 1410 nt, Artificial Sequence
  derived and/or modified CDS sequence (AUadapt) from InfluenzaA__ADG42446__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 21119 - RNA, 1410 nt, Artificial Sequence
  derived and/or modified CDS sequence (AUadapt) from InfluenzaA__ADG42456__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21120 - RNA, 1410 nt, Artificial Sequence; identical to SEQ ID NO: 16318
  derived and/or modified CDS sequence (AUadapt) from InfluenzaA__ADG42466__NA

SEQ ID NO: 21121 - RNA, 1410 nt, Artificial Sequence
  derived and/or modified CDS sequence (AUadapt) from InfluenzaA__ADG42476__NA
augaaccccaaccagaagaucaucaccaucggcucggugugcaugaccaucgggauggccaaccugauccuccagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21122 - RNA, 1410 nt, Artificial Sequence; identical to SEQ ID NO: 21042
  derived and/or modified CDS sequence (AUadapt) from InfluenzaA__ADG42486__NA

SEQ ID NO: 21123 - RNA, 1410 nt, Artificial Sequence; identical to SEQ ID NO: 16318
  derived and/or modified CDS sequence (AUadapt) from InfluenzaA__ADG42496__NA

SEQ ID NO: 21124 - RNA, 1410 nt, Artificial Sequence
  derived and/or modified CDS sequence (AUadapt) from InfluenzaA__ADG42506__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcaucaucacguacgagaacaacaccugggucaaccagaccuacgugaacaucuccaacaccaacuucgccgcgggccagagcguggucuccgugaagcuggccgggaacagcucccucugcccggugucgggcugggccaucuacuccaaggacaacagcauccgcaucggcuccaagggggacgucuucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagucggucgccugguccgcgagcgccugccacgacgggaucaacuggcucacgaucggcaucuccggccccgacaacggggccguggccgugcugaaguacaacggcaucaucaccgacaccaucaagagcuggcgcaacaacauccugcggacccaggaguccgagugcgcgugcgucaacgggagcugcuucacggugaugaccgacggcccguccgacggccaggccagcuacaagaucuuccgcaucgagaaggggaagguggucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 21125 - RNA, 1410 nt, Artificial Sequence; identical to SEQ ID NO: 20315
  derived and/or modified CDS sequence (AUadapt) from InfluenzaA__ADG42516__NA

SEQ ID NO: 21126 - RNA, 1410 nt, Artificial Sequence
  derived and/or modified CDS sequence (AUadapt) from InfluenzaA__ADG42526__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugccucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21127 - RNA, 1410 nt, Artificial Sequence
  derived and/or modified CDS sequence (AUadapt) from InfluenzaA__ADG42536__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaccagcgacacggucgggugguccuggcccgacggcgccgagcugccguucaccaucgacaaguga

SEQ ID NO: 21128 - RNA, 1410 nt, Artificial Sequence; identical to SEQ ID NO: 16318
  derived and/or modified CDS sequence (AUadapt) from InfluenzaA__ADG42546__NA

SEQ ID NO: 21129 - RNA, 1410 nt, Artificial Sequence; identical to SEQ ID NO: 16318
  derived and/or modified CDS sequence (AUadapt) from InfluenzaA__ADG42556__NA

SEQ ID NO: 21130 - RNA, 1410 nt, Artificial Sequence
  derived and/or modified CDS sequence (AUadapt) from InfluenzaA__ADG42566__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccacagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21131 - RNA, 1410 nt, Artificial Sequence
  derived and/or modified CDS sequence (AUadapt) from InfluenzaA__ADG42576__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccuacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucucgucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21132 - RNA, 1410 nt, Artificial Sequence; identical to SEQ ID NO: 16318
  derived and/or modified CDS sequence (AUadapt) from InfluenzaA__ADG42586__NA

SEQ ID NO: 21133 - RNA, 1410 nt, Artificial Sequence
  derived and/or modified CDS sequence (AUadapt) from InfluenzaA__ADG42606__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguuccccaucgacaaguga

SEQ ID NO: 21134 - RNA, 1410 nt, Artificial Sequence
  derived and/or modified CDS sequence (AUadapt) from InfluenzaA__ADG42616__NA
augaacucgaaccagaagaucaucaccaucggcuccgugugcaugaccaucgggauggccaaccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugccccgucuccggcugggccaucuacagcaaggacaacuccauccgcaucggcagcaagggggacguguucgugauccgggagccguucaucuccugcagcccccuggagugccgcaccuucuuccugacccagggcgcccuccugaacgacaagcacuccaacgggaccaucaaggaccggucgcccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 21135 - RNA, 1410 nt, Artificial Sequence; identical to SEQ ID NO: 19723
  derived and/or modified CDS sequence (AUadapt) from InfluenzaA__ADG42626__NA

SEQ ID NO: 21136 - RNA, 1410 nt, Artificial Sequence; identical to SEQ ID NO: 21121
  derived and/or modified CDS sequence (AUadapt) from InfluenzaA__ADG42636__NA

SEQ ID NO: 21137 - RNA, 1410 nt, Artificial Sequence
  derived and/or modified CDS sequence (AUadapt) from InfluenzaA__ADG42646__NA
augaaccccaaccagcgcaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21138 - RNA, 1410 nt, Artificial Sequence; identical to SEQ ID NO: 16318
  derived and/or modified CDS sequence (AUadapt) from InfluenzaA__ADG42656__NA

SEQ ID NO: 21139 - RNA, 1410 nt, Artificial Sequence; identical to SEQ ID NO: 21053
  derived and/or modified CDS sequence (AUadapt) from InfluenzaA__ADG42666__NA

SEQ ID NO: 21140 - RNA, 1410 nt, Artificial Sequence
  derived and/or modified CDS sequence (AUadapt) from InfluenzaA__ADG42676__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagaucugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 21141 - RNA, 1410 nt, Artificial Sequence; identical to SEQ ID NO: 16318
  derived and/or modified CDS sequence (AUadapt) from InfluenzaA__ADG42686__NA

SEQ ID NO: 21142 - RNA, 1410 nt, Artificial Sequence; identical to SEQ ID NO: 20717
  derived and/or modified CDS sequence (AUadapt) from InfluenzaA__ADG42696__NA

SEQ ID NO: 21143 - RNA, 1410 nt, Artificial Sequence; identical to SEQ ID NO: 20921
  derived and/or modified CDS sequence (AUadapt) from InfluenzaA__ADG42706__NA

SEQ ID NO: 21144 - RNA, 1410 nt, Artificial Sequence; identical to SEQ ID NO: 16318
  derived and/or modified CDS sequence (AUadapt) from InfluenzaA__ADG42716__NA

SEQ ID NO: 21145 - RNA, 1410 nt, Artificial Sequence; identical to SEQ ID NO: 20428
  derived and/or modified CDS sequence (AUadapt) from InfluenzaA__ADG42726__NA

SEQ ID NO: 21146 - RNA, 1410 nt, Artificial Sequence; identical to SEQ ID NO: 19723
  derived and/or modified CDS sequence (AUadapt) from InfluenzaA__ADG42746__NA

SEQ ID NO: 21147 - RNA, 1410 nt, Artificial Sequence; identical to SEQ ID NO: 20653
  derived and/or modified CDS sequence (AUadapt) from InfluenzaA__ADG42756__NA

SEQ ID NO: 21148 - RNA, 1410 nt, Artificial Sequence; identical to SEQ ID NO: 20428
  derived and/or modified CDS sequence (AUadapt) from InfluenzaA__ADG42766__NA

SEQ ID NO: 21149 - RNA, 1410 nt, Artificial Sequence; identical to SEQ ID NO: 20428
  derived and/or modified CDS sequence (AUadapt) from InfluenzaA__ADG42776__NA

SEQ ID NO: 21150 - RNA, 1410 nt, Artificial Sequence; identical to SEQ ID NO: 20428
  derived and/or modified CDS sequence (AUadapt) from InfluenzaA__ADG42796__NA

SEQ ID NO: 21151 - RNA, 1410 nt, Artificial Sequence
  derived and/or modified CDS sequence (AUadapt) from InfluenzaA__ADG42806__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucuccuggagcuggcccgacggggccgagcugccguucacgaucgacaaguga

SEQ ID NO: 21152 - RNA, 1410 nt, Artificial Sequence; identical to SEQ ID NO: 16318
  derived and/or modified CDS sequence (AUadapt) from InfluenzaA__ADG42816__NA

SEQ ID NO: 21153 - RNA, 1410 nt, Artificial Sequence; identical to SEQ ID NO: 16318
  derived and/or modified CDS sequence (AUadapt) from InfluenzaA__ADG42826__NA

SEQ ID NO: 21154 - RNA, 1410 nt, Artificial Sequence; identical to SEQ ID NO: 16318
  derived and/or modified CDS sequence (AUadapt) from InfluenzaA__ADG42836__NA

SEQ ID NO: 21155 - RNA, 1410 nt, Artificial Sequence; identical to SEQ ID NO: 20756
  derived and/or modified CDS sequence (AUadapt) from InfluenzaA__ADG42846__NA

SEQ ID NO: 21156 - RNA, 1410 nt, Artificial Sequence; identical to SEQ ID NO: 16318
  derived and/or modified CDS sequence (AUadapt) from InfluenzaA__ADG42856__NA

SEQ ID NO: 21157 - RNA, 1410 nt, Artificial Sequence; identical to SEQ ID NO: 20752
  derived and/or modified CDS sequence (AUadapt) from InfluenzaA__ADG42866__NA

SEQ ID NO: 21158 - RNA, 1410 nt, Artificial Sequence; identical to SEQ ID NO: 16318
  derived and/or modified CDS sequence (AUadapt) from InfluenzaA__ADG42876__NA

SEQ ID NO: 21159 - RNA, 1410 nt, Artificial Sequence; identical to SEQ ID NO: 20789
  derived and/or modified CDS sequence (AUadapt) from InfluenzaA__ADG42886__NA

SEQ ID NO: 21160 - RNA, 1410 nt, Artificial Sequence; identical to SEQ ID NO: 20732
  derived and/or modified CDS sequence (AUadapt) from InfluenzaA__ADG42896__NA

SEQ ID NO: 21161 - RNA, 1410 nt, Artificial Sequence; identical to SEQ ID NO: 20732
  derived and/or modified CDS sequence (AUadapt) from InfluenzaA__ADG42906__NA

SEQ ID NO: 21162 - RNA, 1410 nt, Artificial Sequence; identical to SEQ ID NO: 16318
  derived and/or modified CDS sequence (AUadapt) from InfluenzaA__ADG42916__NA

SEQ ID NO: 21163 - RNA, 1410 nt, Artificial Sequence; identical to SEQ ID NO: 16318
  derived and/or modified CDS sequence (AUadapt) from InfluenzaA__ADG42926__NA

SEQ ID NO: 21164 - RNA, 1410 nt, Artificial Sequence; identical to SEQ ID NO: 16318
  derived and/or modified CDS sequence (AUadapt) from InfluenzaA__ADG58909__NA

SEQ ID NO: 21165 - RNA, 1410 nt, Artificial Sequence; identical to SEQ ID NO: 16318
  derived and/or modified CDS sequence (AUadapt) from InfluenzaA__ADG58910__NA

SEQ ID NO: 21166 - RNA, 1410 nt, Artificial Sequence
  derived and/or modified CDS sequence (AUadapt) from InfluenzaA__ADG58913__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucaccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggucguucgugcagcacccggagcugaccggccuggacugcauccgccccugcuucuggaucgagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 21167 - RNA, 1410 nt, Artificial Sequence; identical to SEQ ID NO: 16318
  derived and/or modified CDS sequence (AUadapt) from InfluenzaA__ADG58914__NA

SEQ ID NO: 21168 - RNA, 1410 nt, Artificial Sequence; identical to SEQ ID NO: 16318
  derived and/or modified CDS sequence (AUadapt) from InfluenzaA__ADG58916__NA

SEQ ID NO: 21169 - RNA, 1410 nt, Artificial Sequence; identical to SEQ ID NO: 16318
  derived and/or modified CDS sequence (AUadapt) from InfluenzaA__ADG58917__NA

SEQ ID NO: 21170 - RNA, 1410 nt, Artificial Sequence
  derived and/or modified CDS sequence (AUadapt) from InfluenzaA__ADG58918__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucaccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggucguucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 21171 - RNA, 1410 nt, Artificial Sequence; identical to SEQ ID NO: 21166
  derived and/or modified CDS sequence (AUadapt) from InfluenzaA__ADG58919__NA

SEQ ID NO: 21172 - RNA, 1410 nt, Artificial Sequence; identical to SEQ ID NO: 19295
  derived and/or modified CDS sequence (AUadapt) from InfluenzaA__ADG58920__NA

SEQ ID NO: 21173 - RNA, 1410 nt, Artificial Sequence; identical to SEQ ID NO: 19295
  derived and/or modified CDS sequence (AUadapt) from InfluenzaA__ADG58921__NA

SEQ ID NO: 21174 - RNA, 1410 nt, Artificial Sequence; identical to SEQ ID NO: 19295
  derived and/or modified CDS sequence (AUadapt) from InfluenzaA__ADG58922__NA

SEQ ID NO: 21175 - RNA, 1410 nt, Artificial Sequence; identical to SEQ ID NO: 19295
  derived and/or modified CDS sequence (AUadapt) from InfluenzaA__ADG58923__NA

SEQ ID NO: 21176 - RNA, 1410 nt, Artificial Sequence; identical to SEQ ID NO: 19295
  derived and/or modified CDS sequence (AUadapt) from InfluenzaA__ADG58924__NA

SEQ ID NO: 21177 - RNA, 1410 nt, Artificial Sequence; identical to SEQ ID NO: 19295
  derived and/or modified CDS sequence (AUadapt) from InfluenzaA__ADG58925__NA

SEQ ID NO: 21178 - RNA, 1410 nt, Artificial Sequence; identical to SEQ ID NO: 19295
  derived and/or modified CDS sequence (AUadapt) from InfluenzaA__ADG58926__NA

SEQ ID NO: 21179 - RNA, 1410 nt, Artificial Sequence; identical to SEQ ID NO: 19295
  derived and/or modified CDS sequence (AUadapt) from InfluenzaA__ADG58927__NA

SEQ ID NO: 21180 - RNA, 1410 nt, Artificial Sequence; identical to SEQ ID NO: 20158
  derived and/or modified CDS sequence (AUadapt) from InfluenzaA__ADG58928__NA

SEQ ID NO: 21181 - RNA, 1410 nt, Artificial Sequence; identical to SEQ ID NO: 20158
  derived and/or modified CDS sequence (AUadapt) from InfluenzaA__ADG58929__NA

SEQ ID NO: 21182 - RNA, 1410 nt, Artificial Sequence
  derived and/or modified CDS sequence (AUadapt) from InfluenzaA__ADG58931__NA
augaaccccaaccagaagaucaucaccaucggcucggugugcaugaccaucgggauggccaaccugauccuccagaucggcaacacgaucuccaucuggaucaaccacagcauccagcuggggaaccagaaccagaucgagaccugcaaccaguccgucaucaccuacgagaacaacaccugggugaaccagacguacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggacgaucaaggaccggagccccuaccgcacccugauguccugcccgaucggcgagguccccagccccuacaacucccgguucgagucgguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucucgagccggaacggcuucgagaugaucugggaccccaacggguggaccggcacggacaacaacuucuccaucaagcaggacaucguggggaucaacgaguggagcggcuacuccgggucguucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 21183 - RNA, 1410 nt, Artificial Sequence; identical to SEQ ID NO: 21182
  derived and/or modified CDS sequence (AUadapt) from InfluenzaA__ADG58932__NA

SEQ ID NO: 21184 - RNA, 1410 nt, Artificial Sequence; identical to SEQ ID NO: 21182
  derived and/or modified CDS sequence (AUadapt) from InfluenzaA__ADG58933__NA

SEQ ID NO: 21185 - RNA, 1410 nt, Artificial Sequence; identical to SEQ ID NO: 21182
  derived and/or modified CDS sequence (AUadapt) from InfluenzaA__ADG58934__NA

SEQ ID NO: 21186 - RNA, 1410 nt, Artificial Sequence; identical to SEQ ID NO: 21182
  derived and/or modified CDS sequence (AUadapt) from InfluenzaA__ADG58935__NA

SEQ ID NO: 21187 - RNA, 1410 nt, Artificial Sequence; identical to SEQ ID NO: 21182
  derived and/or modified CDS sequence (AUadapt) from InfluenzaA__ADG58936__NA

SEQ ID NO: 21188 - RNA, 1410 nt, Artificial Sequence; identical to SEQ ID NO: 21182
  derived and/or modified CDS sequence (AUadapt) from InfluenzaA__ADG58937__NA

SEQ ID NO: 21189 - RNA, 1410 nt, Artificial Sequence; identical to SEQ ID NO: 21182
  derived and/or modified CDS sequence (AUadapt) from InfluenzaA__ADG58938__NA

SEQ ID NO: 21190 - RNA, 1410 nt, Artificial Sequence
  derived and/or modified CDS sequence (AUadapt) from InfluenzaA__ADG59589__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccauggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagguggucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21191 - RNA, 1410 nt, Artificial Sequence; identical to SEQ ID NO: 16318
  derived and/or modified CDS sequence (AUadapt) from InfluenzaA__ADG59590__NA

SEQ ID NO: 21192 - RNA, 1410 nt, Artificial Sequence; identical to SEQ ID NO: 16318
  derived and/or modified CDS sequence (AUadapt) from InfluenzaA__ADG59591__NA

SEQ ID NO: 21193 - RNA, 1410 nt, Artificial Sequence; identical to SEQ ID NO: 16318
  derived and/or modified CDS sequence (AUadapt) from InfluenzaA__ADG59592__NA

SEQ ID NO: 21194 - RNA, 1410 nt, Artificial Sequence; identical to SEQ ID NO: 21042
  derived and/or modified CDS sequence (AUadapt) from InfluenzaA__ADG59593__NA

SEQ ID NO: 21195 - RNA, 1410 nt, Artificial Sequence; identical to SEQ ID NO: 20317
  derived and/or modified CDS sequence (AUadapt) from InfluenzaA__ADG59594__NA

SEQ ID NO: 21196 - RNA, 1410 nt, Artificial Sequence; identical to SEQ ID NO: 20317
  derived and/or modified CDS sequence (AUadapt) from InfluenzaA__ADG59595__NA

SEQ ID NO: 21197 - RNA, 1410 nt, Artificial Sequence
  derived and/or modified CDS sequence (AUadapt) from InfluenzaA__ADG59596__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgaccgcaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21198 - RNA, 1410 nt, Artificial Sequence; identical to SEQ ID NO: 16318
  derived and/or modified CDS sequence (AUadapt) from InfluenzaA__ADG59597__NA

SEQ ID NO: 21199 - RNA, 1410 nt, Artificial Sequence; identical to SEQ ID NO: 16318
  derived and/or modified CDS sequence (AUadapt) from InfluenzaA__ADG59598__NA

SEQ ID NO: 21200 - RNA, 1410 nt, Artificial Sequence; identical to SEQ ID NO: 20315
  derived and/or modified CDS sequence (AUadapt) from InfluenzaA__ADG59599__NA

SEQ ID NO: 21201 - RNA, 1410 nt, Artificial Sequence; identical to SEQ ID NO: 16318
  derived and/or modified CDS sequence (AUadapt) from InfluenzaA__ADG59601__NA

SEQ ID NO: 21202 - RNA, 1410 nt, Artificial Sequence; identical to SEQ ID NO: 21042
  derived and/or modified CDS sequence (AUadapt) from InfluenzaA__ADG59602__NA

SEQ ID NO: 21203 - RNA, 1410 nt, Artificial Sequence; identical to SEQ ID NO: 21042
  derived and/or modified CDS sequence (AUadapt) from InfluenzaA__ADG59603__NA

SEQ ID NO: 21204 - RNA, 1410 nt, Artificial Sequence; identical to SEQ ID NO: 16318
  derived and/or modified CDS sequence (AUadapt) from InfluenzaA__ADG59604__NA

SEQ ID NO: 21205 - RNA, 1410 nt, Artificial Sequence; identical to SEQ ID NO: 16318
  derived and/or modified CDS sequence (AUadapt) from InfluenzaA__ADG59605__NA

SEQ ID NO: 21206 - RNA, 1410 nt, Artificial Sequence; identical to SEQ ID NO: 20158
  derived and/or modified CDS sequence (AUadapt) from InfluenzaA__ADG59606__NA

SEQ ID NO: 21207 - RNA, 1410 nt, Artificial Sequence; identical to SEQ ID NO: 16318
  derived and/or modified CDS sequence (AUadapt) from InfluenzaA__ADG59607__NA

SEQ ID NO: 21208 - RNA, 1410 nt, Artificial Sequence; identical to SEQ ID NO: 16318
  derived and/or modified CDS sequence (AUadapt) from InfluenzaA__ADG59608__NA

SEQ ID NO: 21209 - RNA, 1410 nt, Artificial Sequence; identical to SEQ ID NO: 19961
  derived and/or modified CDS sequence (AUadapt) from InfluenzaA__ADG59609__NA

SEQ ID NO: 21210 - RNA, 1410 nt, Artificial Sequence; identical to SEQ ID NO: 21042
  derived and/or modified CDS sequence (AUadapt) from InfluenzaA__ADG59610__NA

SEQ ID NO: 21211 - RNA, 1410 nt, Artificial Sequence; identical to SEQ ID NO: 20158
  derived and/or modified CDS sequence (AUadapt) from InfluenzaA__ADG59611__NA

SEQ ID NO: 21212 - RNA, 1410 nt, Artificial Sequence; identical to SEQ ID NO: 21042
  derived and/or modified CDS sequence (AUadapt) from InfluenzaA__ADG59612__NA

SEQ ID NO: 21213 - RNA, 1410 nt, Artificial Sequence
  derived and/or modified CDS sequence (AUadapt) from InfluenzaA__ADG59613__NA
augaaccccaaccagaagaucaucaccaucggcucggugugcaugaccaucgggaugacgaaccugauccuccagcugggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgccggccagagcgucguguccgugaagcucgcggggaacucgucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggacgaucaaggaccggucccccuaccgcacccucaugucgugcccgaucggcgagguccccucccccuacaacagccgguucgagagcguggccugguccgccagcgcgugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgccugcgugaacgggucgugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacagcuucuccaucaagcaggacaucguggggaucaacgaguggucgggcuacuccgggagcuucgugcagcacccggagcugaccggccucgacugcauccgccccugcuucugggucgagcugauccggggccgccccaaggagaacaccguguggaccuccgggagcuccaucagcuucugcggcgucaacuccgacacggugggguggagcuggcccgacggcgccgagcugccguucaccaucgacaaguga

SEQ ID NO: 21214 - RNA, 1410 nt, Artificial Sequence; identical to SEQ ID NO: 20315
  derived and/or modified CDS sequence (AUadapt) from InfluenzaA__ADG59614__NA

SEQ ID NO: 21215 - RNA, 1410 nt, Artificial Sequence; identical to SEQ ID NO: 16318
  derived and/or modified CDS sequence (AUadapt) from InfluenzaA__ADH01811__NA

SEQ ID NO: 21216 - RNA, 1410 nt, Artificial Sequence; identical to SEQ ID NO: 16318
  derived and/or modified CDS sequence (AUadapt) from InfluenzaA__ADH01821__NA

SEQ ID NO: 21217 - RNA, 1410 nt, Artificial Sequence; identical to SEQ ID NO: 16318
  derived and/or modified CDS sequence (AUadapt) from InfluenzaA__ADH01831__NA

SEQ ID NO: 21218 - RNA, 1410 nt, Artificial Sequence; identical to SEQ ID NO: 16318
  derived and/or modified CDS sequence (AUadapt) from InfluenzaA__ADH01841__NA

SEQ ID NO: 21219 - RNA, 1410 nt, Artificial Sequence; identical to SEQ ID NO: 16318
  derived and/or modified CDS sequence (AUadapt) from InfluenzaA__ADH01851__NA

SEQ ID NO: 21220 - RNA, 1410 nt, Artificial Sequence; identical to SEQ ID NO: 16318
  derived and/or modified CDS sequence (AUadapt) from InfluenzaA__ADH01861__NA

SEQ ID NO: 21221 - RNA, 1410 nt, Artificial Sequence; identical to SEQ ID NO: 16318
  derived and/or modified CDS sequence (AUadapt) from InfluenzaA__ADH01871__NA

SEQ ID NO: 21222 - RNA, 1410 nt, Artificial Sequence; identical to SEQ ID NO: 16318
  derived and/or modified CDS sequence (AUadapt) from InfluenzaA__ADH01881__NA

SEQ ID NO: 21223 - RNA, 1410 nt, Artificial Sequence; identical to SEQ ID NO: 16318
  derived and/or modified CDS sequence (AUadapt) from InfluenzaA__ADH01891__NA

SEQ ID NO: 21224 - RNA, 1410 nt, Artificial Sequence; identical to SEQ ID NO: 16318
  derived and/or modified CDS sequence (AUadapt) from InfluenzaA__ADH01901__NA

SEQ ID NO: 21225 - RNA, 1410 nt, Artificial Sequence; identical to SEQ ID NO: 16318
  derived and/or modified CDS sequence (AUadapt) from InfluenzaA__ADH01911__NA

SEQ ID NO: 21226 - RNA, 1410 nt, Artificial Sequence; identical to SEQ ID NO: 16318
  derived and/or modified CDS sequence (AUadapt) from InfluenzaA__ADH01921__NA

SEQ ID NO: 21227 - RNA, 1410 nt, Artificial Sequence; identical to SEQ ID NO: 16318
  derived and/or modified CDS sequence (AUadapt) from InfluenzaA__ADH01931__NA

SEQ ID NO: 21228 - RNA, 1410 nt, Artificial Sequence; identical to SEQ ID NO: 21031
  derived and/or modified CDS sequence (AUadapt) from InfluenzaA__ADH01941__NA

SEQ ID NO: 21229 - RNA, 1410 nt, Artificial Sequence; identical to SEQ ID NO: 16318
  derived and/or modified CDS sequence (AUadapt) from InfluenzaA__ADH01951__NA

SEQ ID NO: 21230 - RNA, 1410 nt, Artificial Sequence; identical to SEQ ID NO: 16318
  derived and/or modified CDS sequence (AUadapt) from InfluenzaA__ADH01961__NA

SEQ ID NO: 21231 - RNA, 1410 nt, Artificial Sequence
  derived and/or modified CDS sequence (AUadapt) from InfluenzaA__ADH01981__NA
augaaccccaaccagaagaucaucaccaucggcucggccugcaugaccaucgggauggccaaccugauccuccagaucggcaacaucaucuccaucuggaucagccacuccauccagcuggggaaccagaaccagacggagaccugcaaccagagcgugaucaccuacgagaacaacaccugggucaaccagacguacgugaacaucuccaacaccaacuucgcggccggccagucgguggucuccgugaagcuggccgggaacagcucccucugcccggugagcggcugggccaucuacuccaaggacaacagcauccgcaucggcuccaagggggacgucuucgugauccgggagcccuucaucucgugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacucgcgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagucgaucagcucccggaacggcuucgagaugaucugggaccccaacggguggaccggcacggacaacaacuucagcaucaagcaggacaucgucgggaucaacgagugguccggcuacucgggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgcggagcugccguucaccaucgacaaguga

SEQ ID NO: 21232 - RNA, 1410 nt, Artificial Sequence; identical to SEQ ID NO: 20428
  derived and/or modified CDS sequence (AUadapt) from InfluenzaA__ADH01991__NA

SEQ ID NO: 21233 - RNA, 1410 nt, Artificial Sequence; identical to SEQ ID NO: 21097
  derived and/or modified CDS sequence (AUadapt) from InfluenzaA__ADH02011__NA

SEQ ID NO: 21234 - RNA, 1410 nt, Artificial Sequence; identical to SEQ ID NO: 20317
  derived and/or modified CDS sequence (AUadapt) from InfluenzaA__ADH02021__NA

SEQ ID NO: 21235 - RNA, 1410 nt, Artificial Sequence; identical to SEQ ID NO: 16318
  derived and/or modified CDS sequence (AUadapt) from InfluenzaA__ADI24510__NA

SEQ ID NO: 21236 - RNA, 1410 nt, Artificial Sequence; identical to SEQ ID NO: 16318
  derived and/or modified CDS sequence (AUadapt) from InfluenzaA__ADI24516__NA

SEQ ID NO: 21237 - RNA, 1410 nt, Artificial Sequence; identical to SEQ ID NO: 16318
  derived and/or modified CDS sequence (AUadapt) from InfluenzaA__ADI24518__NA

SEQ ID NO: 21238 - RNA, 1410 nt, Artificial Sequence; identical to SEQ ID NO: 16318
  derived and/or modified CDS sequence (AUadapt) from InfluenzaA__ADI24522__NA

SEQ ID NO: 21239 - RNA, 1410 nt, Artificial Sequence; identical to SEQ ID NO: 16318
  derived and/or modified CDS sequence (AUadapt) from InfluenzaA__ADI24524__NA

SEQ ID NO: 21240 - RNA, 1410 nt, Artificial Sequence; identical to SEQ ID NO: 16318
  derived and/or modified CDS sequence (AUadapt) from InfluenzaA__ADI24526__NA

SEQ ID NO: 21241 - RNA, 1410 nt, Artificial Sequence; identical to SEQ ID NO: 16318
  derived and/or modified CDS sequence (AUadapt) from InfluenzaA__ADI24528__NA

SEQ ID NO: 21242 - RNA, 1410 nt, Artificial Sequence; identical to SEQ ID NO: 16318
  derived and/or modified CDS sequence (AUadapt) from InfluenzaA__ADI24530__NA

SEQ ID NO: 21243 - RNA, 1410 nt, Artificial Sequence
  derived and/or modified CDS sequence (AUadapt) from InfluenzaA__ADI24532__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcuccggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21244 - RNA, 1410 nt, Artificial Sequence; identical to SEQ ID NO: 16318
  derived and/or modified CDS sequence (AUadapt) from InfluenzaA__ADI24538__NA

SEQ ID NO: 21245 - RNA, 1410 nt, Artificial Sequence; identical to SEQ ID NO: 16318
  derived and/or modified CDS sequence (AUadapt) from InfluenzaA__ADI24548__NA

SEQ ID NO: 21246 - RNA, 1410 nt, Artificial Sequence; identical to SEQ ID NO: 16318
  derived and/or modified CDS sequence (AUadapt) from InfluenzaA__ADI24556__NA

SEQ ID NO: 21247 - RNA, 1410 nt, Artificial Sequence; identical to SEQ ID NO: 16318
  derived and/or modified CDS sequence (AUadapt) from InfluenzaA__ADI24558__NA

SEQ ID NO: 21248 - RNA, 1410 nt, Artificial Sequence; identical to SEQ ID NO: 16318
  derived and/or modified CDS sequence (AUadapt) from InfluenzaA__ADI24560__NA

SEQ ID NO: 21249 - RNA, 1410 nt, Artificial Sequence; identical to SEQ ID NO: 16318
  derived and/or modified CDS sequence (AUadapt) from InfluenzaA__ADI24562__NA

SEQ ID NO: 21250 - RNA, 1410 nt, Artificial Sequence; identical to SEQ ID NO: 16318
  derived and/or modified CDS sequence (AUadapt) from InfluenzaA__ADI24564__NA

SEQ ID NO: 21251 - RNA, 1410 nt, Artificial Sequence; identical to SEQ ID NO: 16318
  derived and/or modified CDS sequence (AUadapt) from InfluenzaA__ADI24566__NA

SEQ ID NO: 21252 - RNA, 1410 nt, Artificial Sequence; identical to SEQ ID NO: 16318
  derived and/or modified CDS sequence (AUadapt) from InfluenzaA__ADI24568__NA

SEQ ID NO: 21253 - RNA, 1410 nt, Artificial Sequence; identical to SEQ ID NO: 16318
  derived and/or modified CDS sequence (AUadapt) from InfluenzaA__ADI24570__NA

SEQ ID NO: 21254 - RNA, 1410 nt, Artificial Sequence; identical to SEQ ID NO: 16318
  derived and/or modified CDS sequence (AUadapt) from InfluenzaA__ADI24572__NA

SEQ ID NO: 21255 - RNA, 1410 nt, Artificial Sequence; identical to SEQ ID NO: 16318
  derived and/or modified CDS sequence (AUadapt) from InfluenzaA__ADI24574__NA

SEQ ID NO: 21256 - RNA, 1410 nt, Artificial Sequence; identical to SEQ ID NO: 16318
  derived and/or modified CDS sequence (AUadapt) from InfluenzaA__ADI24576__NA

SEQ ID NO: 21257 - RNA, 1410 nt, Artificial Sequence; identical to SEQ ID NO: 16318
  derived and/or modified CDS sequence (AUadapt) from InfluenzaA__ADI24580__NA

SEQ ID NO: 21258 - RNA, 1410 nt, Artificial Sequence; identical to SEQ ID NO: 20315
  derived and/or modified CDS sequence (AUadapt) from InfluenzaA__ADI24582__NA

SEQ ID NO: 21259 - RNA, 1410 nt, Artificial Sequence
  derived and/or modified CDS sequence (AUadapt) from InfluenzaA__ADI24584__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucgugccggugaagcuggccgggaacuccagccucugccccgucaacggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccgguccccguaccgcacgcugaugagcugccccaucggcgagguccccucccccuacaacagccgguucgaguccguggccuggagcgcgucggccugccacgacgggaucaacuggcucaccaucggcaucuccggcccggacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaccggcagcugcggccccguguccucgaacggggccaacggcgugaagggguucuccuucaaguacggcaacggggucuggaucggccgcaccaagagcaucuccagccggaacggcuucgagaugaucugggacccgaacggguggaccggcaccgacaacaacuucagcaucaagcaggacaucguggggaucaacgagugguccggcuacucgggguccuucgugcagcaccccgagcugacgggccuggacugcauccgccccugcuucugggucgagcucauccggggccgccccaaggagaacaccaucuggaccagcggguccagcaucuccuucugcggcgugaacagcgacaccgucgggugguccuggccggacggcgccgagcugcccuucacgaucgacaaguga

SEQ ID NO: 21260 - RNA, 1410 nt, Artificial Sequence; identical to SEQ ID NO: 19494
  derived and/or modified CDS sequence (AUadapt) from InfluenzaA__ADI24592__NA

SEQ ID NO: 21261 - RNA, 1410 nt, Artificial Sequence; identical to SEQ ID NO: 16318
  derived and/or modified CDS sequence (AUadapt) from InfluenzaA__ADI24598__NA

SEQ ID NO: 21262 - RNA, 1410 nt, Artificial Sequence; identical to SEQ ID NO: 16318
  derived and/or modified CDS sequence (AUadapt) from InfluenzaA__ADI24604__NA

SEQ ID NO: 21263 - RNA, 1410 nt, Artificial Sequence; identical to SEQ ID NO: 16318
  derived and/or modified CDS sequence (AUadapt) from InfluenzaA__ADI24620__NA

SEQ ID NO: 21264 - RNA, 1410 nt, Artificial Sequence; identical to SEQ ID NO: 16318
  derived and/or modified CDS sequence (AUadapt) from InfluenzaA__ADI24622__NA

SEQ ID NO: 21265 - RNA, 1410 nt, Artificial Sequence; identical to SEQ ID NO: 19494
  derived and/or modified CDS sequence (AUadapt) from InfluenzaA__ADI46780__NA

SEQ ID NO: 21266 - RNA, 1410 nt, Artificial Sequence
  derived and/or modified CDS sequence (AUadapt) from InfluenzaA__ADI46789__NA
augaaccccaaccagaagaucaucaccaucggcucggugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacgagcaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccgggaucuucggcgacaacccgcggcccaacgacaagaccgggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 21267 - RNA, 1410 nt, Artificial Sequence; identical to SEQ ID NO: 16318
  derived and/or modified CDS sequence (AUadapt) from InfluenzaA__ADI48185__NA

SEQ ID NO: 21268 - RNA, 1410 nt, Artificial Sequence; identical to SEQ ID NO: 16318
  derived and/or modified CDS sequence (AUadapt) from InfluenzaA__ADI48187__NA

SEQ ID NO: 21269 - RNA, 1410 nt, Artificial Sequence; identical to SEQ ID NO: 16318
  derived and/or modified CDS sequence (AUadapt) from InfluenzaA__ADI48189__NA

SEQ ID NO: 21270 - RNA, 1410 nt, Artificial Sequence; identical to SEQ ID NO: 16318
  derived and/or modified CDS sequence (AUadapt) from InfluenzaA__ADI48191__NA

SEQ ID NO: 21271 - RNA, 1410 nt, Artificial Sequence; identical to SEQ ID NO: 16318
  derived and/or modified CDS sequence (AUadapt) from InfluenzaA__ADI48193__NA

SEQ ID NO: 21272 - RNA, 1410 nt, Artificial Sequence; identical to SEQ ID NO: 16318
  derived and/or modified CDS sequence (AUadapt) from InfluenzaA__ADI48195__NA

SEQ ID NO: 21273 - RNA, 1410 nt, Artificial Sequence
  derived and/or modified CDS sequence (AUadapt) from InfluenzaA__ADI48197__NA
augaaccccaaccagaagaucaucaccaucggcucggugugcaugaccaucgggauggccaaccugauccuccagaucggcaacaucaucuccaucuggaucagccacuccauccaguucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21274 - RNA, 1410 nt, Artificial Sequence; identical to SEQ ID NO: 16318
  derived and/or modified CDS sequence (AUadapt) from InfluenzaA__ADI48199__NA

SEQ ID NO: 21275 - RNA, 1410 nt, Artificial Sequence; identical to SEQ ID NO: 16318
  derived and/or modified CDS sequence (AUadapt) from InfluenzaA__ADI48201__NA

SEQ ID NO: 21276 - RNA, 1410 nt, Artificial Sequence; identical to SEQ ID NO: 16318
  derived and/or modified CDS sequence (AUadapt) from InfluenzaA__ADI48203__NA

SEQ ID NO: 21277 - RNA, 1410 nt, Artificial Sequence
  derived and/or modified CDS sequence (AUadapt) from InfluenzaA__ADI48205__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucccaccuggagugccgcaccuucuuccugacccagggcgcccuccugaacgacaagcacagcaacgggaccaucaaggaccggucccccuaccgcacgcugaugucgugccccaucggcgaggucccgucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 21278 - RNA, 1410 nt, Artificial Sequence; identical to SEQ ID NO: 16318
  derived and/or modified CDS sequence (AUadapt) from InfluenzaA__ADI48207__NA

SEQ ID NO: 21279 - RNA, 1410 nt, Artificial Sequence; identical to SEQ ID NO: 16318
  derived and/or modified CDS sequence (AUadapt) from InfluenzaA__ADI48209__NA

SEQ ID NO: 21280 - RNA, 1410 nt, Artificial Sequence; identical to SEQ ID NO: 16318
  derived and/or modified CDS sequence (AUadapt) from InfluenzaA__ADI48211__NA

SEQ ID NO: 21281 - RNA, 1410 nt, Artificial Sequence; identical to SEQ ID NO: 16318
  derived and/or modified CDS sequence (AUadapt) from InfluenzaA__ADI48213__NA

SEQ ID NO: 21282 - RNA, 1410 nt, Artificial Sequence; identical to SEQ ID NO: 16318
  derived and/or modified CDS sequence (AUadapt) from InfluenzaA__ADI48215__NA

SEQ ID NO: 21283 - RNA, 1410 nt, Artificial Sequence; identical to SEQ ID NO: 16318
  derived and/or modified CDS sequence (AUadapt) from InfluenzaA__ADI48217__NA

SEQ ID NO: 21284 - RNA, 1410 nt, Artificial Sequence; identical to SEQ ID NO: 16318
  derived and/or modified CDS sequence (AUadapt) from InfluenzaA__ADI48219__NA

SEQ ID NO: 21285 - RNA, 1410 nt, Artificial Sequence; identical to SEQ ID NO: 16318
  derived and/or modified CDS sequence (AUadapt) from InfluenzaA__ADI48221__NA

SEQ ID NO: 21286 - RNA, 1410 nt, Artificial Sequence; identical to SEQ ID NO: 16318
  derived and/or modified CDS sequence (AUadapt) from InfluenzaA__ADI48625__NA

SEQ ID NO: 21287 - RNA, 1410 nt, Artificial Sequence; identical to SEQ ID NO: 16318
  derived and/or modified CDS sequence (AUadapt) from InfluenzaA__ADI48635__NA

SEQ ID NO: 21288 - RNA, 1410 nt, Artificial Sequence; identical to SEQ ID NO: 16318
  derived and/or modified CDS sequence (AUadapt) from InfluenzaA__ADI48655__NA

SEQ ID NO: 21289 - RNA, 1410 nt, Artificial Sequence; identical to SEQ ID NO: 16318
  derived and/or modified CDS sequence (AUadapt) from InfluenzaA__ADI48665__NA

SEQ ID NO: 21290 - RNA, 1410 nt, Artificial Sequence
  derived and/or modified CDS sequence (AUadapt) from InfluenzaA__ADI48675__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccugaaggagaacaccaucuggaccagcggguccagcaucuccuucugcggcgugaacagcgacaccgucgggugguccuggcccgacggcgccgagcugcccuucacgaucgacaaguga

SEQ ID NO: 21291 - RNA, 1410 nt, Artificial Sequence
  derived and/or modified CDS sequence (AUadapt) from InfluenzaA__ADI48685__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacggggccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 21292 - RNA, 1410 nt, Artificial Sequence; identical to SEQ ID NO: 16318
  derived and/or modified CDS sequence (AUadapt) from InfluenzaA__ADI48695__NA

SEQ ID NO: 21293 - RNA, 1410 nt, Artificial Sequence; identical to SEQ ID NO: 16274
  derived and/or modified CDS sequence (AUadapt) from InfluenzaA__ADI48705__NA

SEQ ID NO: 21294 - RNA, 1410 nt, Artificial Sequence; identical to SEQ ID NO: 16318
  derived and/or modified CDS sequence (AUadapt) from InfluenzaA__ADI48715__NA

SEQ ID NO: 21295 - RNA, 1410 nt, Artificial Sequence; identical to SEQ ID NO: 16318
  derived and/or modified CDS sequence (AUadapt) from InfluenzaA__ADI48725__NA

SEQ ID NO: 21296 - RNA, 1410 nt, Artificial Sequence; identical to SEQ ID NO: 16318
  derived and/or modified CDS sequence (AUadapt) from InfluenzaA__ADI48735__NA

SEQ ID NO: 21297 - RNA, 1410 nt, Artificial Sequence; identical to SEQ ID NO: 16318
  derived and/or modified CDS sequence (AUadapt) from InfluenzaA__ADI48745__NA

SEQ ID NO: 21298 - RNA, 1410 nt, Artificial Sequence
  derived and/or modified CDS sequence (AUadapt) from InfluenzaA__ADI48755__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucagcgacaccaucaaguccuggcgcaacaacauccugcggacccaggagucggagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 21299 - RNA, 1410 nt, Artificial Sequence; identical to SEQ ID NO: 16318
  derived and/or modified CDS sequence (AUadapt) from InfluenzaA__ADI48765__NA

SEQ ID NO: 21300 - RNA, 1410 nt, Artificial Sequence; identical to SEQ ID NO: 16318
  derived and/or modified CDS sequence (AUadapt) from InfluenzaA__ADI48775__NA

SEQ ID NO: 21301 - RNA, 1410 nt, Artificial Sequence; identical to SEQ ID NO: 16318
  derived and/or modified CDS sequence (AUadapt) from InfluenzaA__ADI48785__NA

SEQ ID NO: 21302 - RNA, 1410 nt, Artificial Sequence; identical to SEQ ID NO: 16318
  derived and/or modified CDS sequence (AUadapt) from InfluenzaA__ADI48795__NA

SEQ ID NO: 21303 - RNA, 1410 nt, Artificial Sequence; identical to SEQ ID NO: 16318
  derived and/or modified CDS sequence (AUadapt) from InfluenzaA__ADI49032__NA

SEQ ID NO: 21304 - RNA, 1410 nt, Artificial Sequence; identical to SEQ ID NO: 16318
  derived and/or modified CDS sequence (AUadapt) from InfluenzaA__ADI49243__NA

SEQ ID NO: 21305 - RNA, 1410 nt, Artificial Sequence; identical to SEQ ID NO: 16318
  derived and/or modified CDS sequence (AUadapt) from InfluenzaA__ADI49263__NA

SEQ ID NO: 21306 - RNA, 1410 nt, Artificial Sequence; identical to SEQ ID NO: 16318
  derived and/or modified CDS sequence (AUadapt) from InfluenzaA__ADI49273__NA

SEQ ID NO: 21307 - RNA, 1410 nt, Artificial Sequence; identical to SEQ ID NO: 16318
  derived and/or modified CDS sequence (AUadapt) from InfluenzaA__ADI49283__NA

SEQ ID NO: 21308 - RNA, 1410 nt, Artificial Sequence; identical to SEQ ID NO: 16318
  derived and/or modified CDS sequence (AUadapt) from InfluenzaA__ADI49315__NA

SEQ ID NO: 21309 - RNA, 1410 nt, Artificial Sequence; identical to SEQ ID NO: 16318
  derived and/or modified CDS sequence (AUadapt) from InfluenzaA__ADI49325__NA

SEQ ID NO: 21310 - RNA, 1410 nt, Artificial Sequence; identical to SEQ ID NO: 16318
  derived and/or modified CDS sequence (AUadapt) from InfluenzaA__ADI49335__NA

SEQ ID NO: 21311 - RNA, 1410 nt, Artificial Sequence
  derived and/or modified CDS sequence (AUadapt) from InfluenzaA__ADI49345__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggaccaucaaggaccggucccccuaccgcacgcucaugagcugcccgaucggcgacguccccucccccuacaacagccgguucgagagcguggccugguccgcgucggccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21312 - RNA, 1410 nt, Artificial Sequence; identical to SEQ ID NO: 16318
  derived and/or modified CDS sequence (AUadapt) from InfluenzaA__ADI49355__NA

SEQ ID NO: 21313 - RNA, 1410 nt, Artificial Sequence; identical to SEQ ID NO: 16318
  derived and/or modified CDS sequence (AUadapt) from InfluenzaA__ADI49365__NA

SEQ ID NO: 21314 - RNA, 1410 nt, Artificial Sequence; identical to SEQ ID NO: 16318
  derived and/or modified CDS sequence (AUadapt) from InfluenzaA__ADI49375__NA

SEQ ID NO: 21315 - RNA, 1410 nt, Artificial Sequence; identical to SEQ ID NO: 16318
  derived and/or modified CDS sequence (AUadapt) from InfluenzaA__ADI49385__NA

SEQ ID NO: 21316 - RNA, 1410 nt, Artificial Sequence
  derived and/or modified CDS sequence (AUadapt) from InfluenzaA__ADI49395__NA
augaaccccaaccagaagaucaucaccaucggcucggugugcaugaccaucgggauggccaaccugauccuccagaucggcaacaugaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagcucaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21317 - RNA, 1410 nt, Artificial Sequence; identical to SEQ ID NO: 16318
  derived and/or modified CDS sequence (AUadapt) from InfluenzaA__ADI49720__NA

SEQ ID NO: 21318 - RNA, 1410 nt, Artificial Sequence; identical to SEQ ID NO: 16318
  derived and/or modified CDS sequence (AUadapt) from InfluenzaA__ADI49730__NA

SEQ ID NO: 21319 - RNA, 1410 nt, Artificial Sequence; identical to SEQ ID NO: 16318
  derived and/or modified CDS sequence (AUadapt) from InfluenzaA__ADI49740__NA

SEQ ID NO: 21320 - RNA, 1410 nt, Artificial Sequence; identical to SEQ ID NO: 16318
  derived and/or modified CDS sequence (AUadapt) from InfluenzaA__ADI49750__NA

SEQ ID NO: 21321 - RNA, 1410 nt, Artificial Sequence; identical to SEQ ID NO: 16318
  derived and/or modified CDS sequence (AUadapt) from InfluenzaA__ADI49760__NA

SEQ ID NO: 21322 - RNA, 1410 nt, Artificial Sequence; identical to SEQ ID NO: 19170
  derived and/or modified CDS sequence (AUadapt) from InfluenzaA__ADI49780__NA

SEQ ID NO: 21323 - RNA, 1410 nt, Artificial Sequence; identical to SEQ ID NO: 16274
  derived and/or modified CDS sequence (AUadapt) from InfluenzaA__ADI49790__NA

SEQ ID NO: 21324 - RNA, 1410 nt, Artificial Sequence; identical to SEQ ID NO: 16318
  derived and/or modified CDS sequence (AUadapt) from InfluenzaA__ADI49821__NA

SEQ ID NO: 21325 - RNA, 1410 nt, Artificial Sequence; identical to SEQ ID NO: 16274
  derived and/or modified CDS sequence (AUadapt) from InfluenzaA__ADI50029__NA

SEQ ID NO: 21326 - RNA, 1410 nt, Artificial Sequence
  derived and/or modified CDS sequence (AUadapt) from InfluenzaA__ADI52830__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgacgagcugccguucacgaucgacaaguga

SEQ ID NO: 21327 - RNA, 1410 nt, Artificial Sequence
  derived and/or modified CDS sequence (AUadapt) from InfluenzaA__ADI52831__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcgugagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21328 - RNA, 1410 nt, Artificial Sequence; identical to SEQ ID NO: 16318
  derived and/or modified CDS sequence (AUadapt) from InfluenzaA__ADI52832__NA

SEQ ID NO: 21329 - RNA, 1410 nt, Artificial Sequence
  derived and/or modified CDS sequence (AUadapt) from InfluenzaA__ADI52833__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggcccccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 21330 - RNA, 1413 nt, Artificial Sequence; identical to SEQ ID NO: 19863
  derived and/or modified CDS sequence (AUadapt) from InfluenzaA__ADI75821__NA

SEQ ID NO: 21331 - RNA, 1410 nt, Artificial Sequence; identical to SEQ ID NO: 20307
  derived and/or modified CDS sequence (AUadapt) from InfluenzaA__ADI75832__NA

SEQ ID NO: 21332 - RNA, 1413 nt, Artificial Sequence
  derived and/or modified CDS sequence (AUadapt) from InfluenzaA__ADI75854__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 21333 - RNA, 1410 nt, Artificial Sequence
  derived and/or modified CDS sequence (AUadapt) from InfluenzaA__ADI75876__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccguggugucguccuacgucugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggugaucgagggguggagcaaccacaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgaccugaaccucaugccgaucuga

SEQ ID NO: 21334 - RNA, 1410 nt, Artificial Sequence; identical to SEQ ID NO: 20307
  derived and/or modified CDS sequence (AUadapt) from InfluenzaA__ADI75887__NA

SEQ ID NO: 21335 - RNA, 1413 nt, Artificial Sequence; identical to SEQ ID NO: 19863
  derived and/or modified CDS sequence (AUadapt) from InfluenzaA__ADI75909__NA

SEQ ID NO: 21336 - RNA, 1410 nt, Artificial Sequence; identical to SEQ ID NO: 20886
  derived and/or modified CDS sequence (AUadapt) from InfluenzaA__ADI75920__NA

SEQ ID NO: 21337 - RNA, 1413 nt, Artificial Sequence; identical to SEQ ID NO: 19863
  derived and/or modified CDS sequence (AUadapt) from InfluenzaA__ADI77352__NA

SEQ ID NO: 21338 - RNA, 1410 nt, Artificial Sequence; identical to SEQ ID NO: 16318
  derived and/or modified CDS sequence (AUadapt) from InfluenzaA__ADI77363__NA

SEQ ID NO: 21339 - RNA, 1410 nt, Artificial Sequence; identical to SEQ ID NO: 20317
  derived and/or modified CDS sequence (AUadapt) from InfluenzaA__ADI99500__NA

SEQ ID NO: 21340 - RNA, 1410 nt, Artificial Sequence
  derived and/or modified CDS sequence (AUadapt) from InfluenzaA__ADI99553__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgacuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgucggccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21341 - RNA, 1410 nt, Artificial Sequence
  derived and/or modified CDS sequence (AUadapt) from InfluenzaA__ADI99563__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggaggugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21342 - RNA, 1410 nt, Artificial Sequence; identical to SEQ ID NO: 21341
  derived and/or modified CDS sequence (AUadapt) from InfluenzaA__ADI99573__NA

SEQ ID NO: 21343 - RNA, 1410 nt, Artificial Sequence; identical to SEQ ID NO: 21341
  derived and/or modified CDS sequence (AUadapt) from InfluenzaA__ADI99583__NA

SEQ ID NO: 21344 - RNA, 1410 nt, Artificial Sequence; identical to SEQ ID NO: 20491
  derived and/or modified CDS sequence (AUadapt) from InfluenzaA__ADI99593__NA

SEQ ID NO: 21345 - RNA, 1410 nt, Artificial Sequence
  derived and/or modified CDS sequence (AUadapt) from InfluenzaA__ADI99613__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 21346 - RNA, 1410 nt, Artificial Sequence
  derived and/or modified CDS sequence (AUadapt) from InfluenzaA__ADI99623__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgccugguccgcgucggccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccaacgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaaguccaucagcagccggaacggcuucgagaugaucugggaccccaacggguggaccggcaccgacaacaacuucuccaucaagcaggacaucgucgggaucaacgaguggagcggcuacuccgggucguucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 21347 - RNA, 1410 nt, Artificial Sequence; identical to SEQ ID NO: 20428
  derived and/or modified CDS sequence (AUadapt) from InfluenzaA__ADI99633__NA

SEQ ID NO: 21348 - RNA, 1410 nt, Artificial Sequence; identical to SEQ ID NO: 20491
  derived and/or modified CDS sequence (AUadapt) from InfluenzaA__ADI99643__NA

SEQ ID NO: 21349 - RNA, 1410 nt, Artificial Sequence; identical to SEQ ID NO: 16318
  derived and/or modified CDS sequence (AUadapt) from InfluenzaA__ADI99653__NA

SEQ ID NO: 21350 - RNA, 1410 nt, Artificial Sequence; identical to SEQ ID NO: 16318
  derived and/or modified CDS sequence (AUadapt) from InfluenzaA__ADI99663__NA

SEQ ID NO: 21351 - RNA, 1410 nt, Artificial Sequence; identical to SEQ ID NO: 16318
  derived and/or modified CDS sequence (AUadapt) from InfluenzaA__ADI99673__NA

SEQ ID NO: 21352 - RNA, 1410 nt, Artificial Sequence; identical to SEQ ID NO: 16318
  derived and/or modified CDS sequence (AUadapt) from InfluenzaA__ADI99683__NA

SEQ ID NO: 21353 - RNA, 1410 nt, Artificial Sequence; identical to SEQ ID NO: 20602
  derived and/or modified CDS sequence (AUadapt) from InfluenzaA__ADI99703__NA

SEQ ID NO: 21354 - RNA, 1410 nt, Artificial Sequence; identical to SEQ ID NO: 16318
  derived and/or modified CDS sequence (AUadapt) from InfluenzaA__ADI99713__NA

SEQ ID NO: 21355 - RNA, 1410 nt, Artificial Sequence; identical to SEQ ID NO: 16318
  derived and/or modified CDS sequence (AUadapt) from InfluenzaA__ADI99723__NA

SEQ ID NO: 21356 - RNA, 1410 nt, Artificial Sequence; identical to SEQ ID NO: 16318
  derived and/or modified CDS sequence (AUadapt) from InfluenzaA__ADI99733__NA

SEQ ID NO: 21357 - RNA, 1410 nt, Artificial Sequence; identical to SEQ ID NO: 19295
  derived and/or modified CDS sequence (AUadapt) from InfluenzaA__ADJ00487__NA

SEQ ID NO: 21358 - RNA, 1410 nt, Artificial Sequence; identical to SEQ ID NO: 19295
  derived and/or modified CDS sequence (AUadapt) from InfluenzaA__ADJ00488__NA

SEQ ID NO: 21359 - RNA, 1410 nt, Artificial Sequence; identical to SEQ ID NO: 19295
  derived and/or modified CDS sequence (AUadapt) from InfluenzaA__ADJ00489__NA

SEQ ID NO: 21360 - RNA, 1410 nt, Artificial Sequence; identical to SEQ ID NO: 19295
  derived and/or modified CDS sequence (AUadapt) from InfluenzaA__ADJ00490__NA

SEQ ID NO: 21361 - RNA, 1410 nt, Artificial Sequence; identical to SEQ ID NO: 19295
  derived and/or modified CDS sequence (AUadapt) from InfluenzaA__ADJ00491__NA

SEQ ID NO: 21362 - RNA, 1410 nt, Artificial Sequence; identical to SEQ ID NO: 16318
  derived and/or modified CDS sequence (AUadapt) from InfluenzaA__ADJ18160__NA

SEQ ID NO: 21363 - RNA, 1410 nt, Artificial Sequence; identical to SEQ ID NO: 16318
  derived and/or modified CDS sequence (AUadapt) from InfluenzaA__ADJ18161__NA

SEQ ID NO: 21364 - RNA, 1410 nt, Artificial Sequence
  derived and/or modified CDS sequence (AUadapt) from InfluenzaA__ADJ18162__NA
augauccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccggaagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21365 - RNA, 1410 nt, Artificial Sequence
  derived and/or modified CDS sequence (AUadapt) from InfluenzaA__ADJ18164__NA
augaaccccaagcagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcagcgucuccggcugggccaucuacagcaaggacaacuccauccgcaucggcagcaagggggacguguucgugauccgggagccguucaucuccugcagcccccuggagugccgcaccuucuuccugacccagggcgcccuccugaacgacaagcacuccaacgggaccaucaaggaccggucgcccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 21366 - RNA, 1410 nt, Artificial Sequence; identical to SEQ ID NO: 16318
  derived and/or modified CDS sequence (AUadapt) from InfluenzaA__ADJ18166__NA

SEQ ID NO: 21367 - RNA, 1410 nt, Artificial Sequence; identical to SEQ ID NO: 16318
  derived and/or modified CDS sequence (AUadapt) from InfluenzaA__ADJ18168__NA

SEQ ID NO: 21368 - RNA, 1410 nt, Artificial Sequence; identical to SEQ ID NO: 16318
  derived and/or modified CDS sequence (AUadapt) from InfluenzaA__ADJ18170__NA

SEQ ID NO: 21369 - RNA, 1410 nt, Artificial Sequence
  derived and/or modified CDS sequence (AUadapt) from InfluenzaA__ADJ18172__NA
augaaccccaaccagaagaucaucaccaucggcucggugugcaugaccaucgggauggccaaccugauccuccgcaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuaccggaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21370 - RNA, 1410 nt, Artificial Sequence; identical to SEQ ID NO: 16318
  derived and/or modified CDS sequence (AUadapt) from InfluenzaA__ADJ18174__NA

SEQ ID NO: 21371 - RNA, 1410 nt, Artificial Sequence
  derived and/or modified CDS sequence (AUadapt) from InfluenzaA__ADJ18176__NA
augaaccccaaccagaagaucaucaccaucggcucggugugcaugaccaucgggauggccaaccugauccuccagaucggcaacaucaucuccaucuggaucagccuguccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucucgggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagucgguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21372 - RNA, 1410 nt, Artificial Sequence; identical to SEQ ID NO: 18913
  derived and/or modified CDS sequence (AUadapt) from InfluenzaA__ADJ37250__NA

SEQ ID NO: 21373 - RNA, 1410 nt, Artificial Sequence
  derived and/or modified CDS sequence (AUadapt) from InfluenzaA__ADJ37252__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaucgugcgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccgucgugagcugguccaaggacauccugcgcacccaggagucggagugcgugugcaucaacgggaccugcacggucgugaugaccgacggguccgccagcggcaaggccgacaccaagauccucuucaucgaggagggcaagaucgugcacaccucgacgcuguccgggagcgcgcagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccagcucccacugccucgaccccaacaacgaggagggcggccacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggaccuacggcacggggagcuggccggacggcgccaacaucaaccugaugcccaucuga

SEQ ID NO: 21374 - RNA, 1410 nt, Artificial Sequence; identical to SEQ ID NO: 16318
  derived and/or modified CDS sequence (AUadapt) from InfluenzaA__ADJ37263__NA

SEQ ID NO: 21375 - RNA, 1410 nt, Artificial Sequence; identical to SEQ ID NO: 16274
  derived and/or modified CDS sequence (AUadapt) from InfluenzaA__ADJ37273__NA

SEQ ID NO: 21376 - RNA, 1410 nt, Artificial Sequence; identical to SEQ ID NO: 16318
  derived and/or modified CDS sequence (AUadapt) from InfluenzaA__ADJ40447__NA

SEQ ID NO: 21377 - RNA, 1410 nt, Artificial Sequence; identical to SEQ ID NO: 16318
  derived and/or modified CDS sequence (AUadapt) from InfluenzaA__ADJ40457__NA

SEQ ID NO: 21378 - RNA, 1410 nt, Artificial Sequence; identical to SEQ ID NO: 20491
  derived and/or modified CDS sequence (AUadapt) from InfluenzaA__ADJ40467__NA

SEQ ID NO: 21379 - RNA, 1410 nt, Artificial Sequence
  derived and/or modified CDS sequence (AUadapt) from InfluenzaA__ADJ40477__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccauggggugguccuggcccgacggcgccgagcugccguucacgaucgacaaguga

SEQ ID NO: 21380 - RNA, 1410 nt, Artificial Sequence; identical to SEQ ID NO: 16318
  derived and/or modified CDS sequence (AUadapt) from InfluenzaA__ADJ40487__NA

SEQ ID NO: 21381 - RNA, 1410 nt, Artificial Sequence; identical to SEQ ID NO: 16318
  derived and/or modified CDS sequence (AUadapt) from InfluenzaA__ADJ40507__NA

SEQ ID NO: 21382 - RNA, 1410 nt, Artificial Sequence; identical to SEQ ID NO: 16318
  derived and/or modified CDS sequence (AUadapt) from InfluenzaA__ADJ40517__NA

SEQ ID NO: 21383 - RNA, 1410 nt, Artificial Sequence; identical to SEQ ID NO: 16318
  derived and/or modified CDS sequence (AUadapt) from InfluenzaA__ADJ40527__NA

SEQ ID NO: 21384 - RNA, 1410 nt, Artificial Sequence
  derived and/or modified CDS sequence (AUadapt) from InfluenzaA__ADJ40537__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcggggucuccgugaagcuggccggcaacucgucccucugcccggugagcggcugggccaucuacuccaaggacaacagcauccgcaucggguccaagggcgacgucuucgugauccgggagcccuucaucagcugcucgccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgucggccugccacgacggcaucaacuggcucaccaucggcaucuccgggcccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacggcccguccgacgggcaggccagcuacaagaucuuccgcaucgagaagggcaagaucgugaaguccgucgagaugaacgcccccaacuaccacuacgaggagugcucgugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccucgaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacucgggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 21385 - RNA, 1410 nt, Artificial Sequence
  derived and/or modified CDS sequence (AUadapt) from InfluenzaA__ADJ40547__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucaucaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucaucgggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21386 - RNA, 1410 nt, Artificial Sequence; identical to SEQ ID NO: 16318
  derived and/or modified CDS sequence (AUadapt) from InfluenzaA__ADJ40557__NA

SEQ ID NO: 21387 - RNA, 1410 nt, Artificial Sequence; identical to SEQ ID NO: 16318
  derived and/or modified CDS sequence (AUadapt) from InfluenzaA__ADJ40577__NA

SEQ ID NO: 21388 - RNA, 1410 nt, Artificial Sequence; identical to SEQ ID NO: 16318
  derived and/or modified CDS sequence (AUadapt) from InfluenzaA__ADJ40587__NA

SEQ ID NO: 21389 - RNA, 1410 nt, Artificial Sequence
  derived and/or modified CDS sequence (AUadapt) from InfluenzaA__ADJ40597__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuuccugaucaagcaggacaucguggggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21390 - RNA, 1410 nt, Artificial Sequence; identical to SEQ ID NO: 16318
  derived and/or modified CDS sequence (AUadapt) from InfluenzaA__ADJ40607__NA

SEQ ID NO: 21391 - RNA, 1410 nt, Artificial Sequence; identical to SEQ ID NO: 16318
  derived and/or modified CDS sequence (AUadapt) from InfluenzaA__ADJ40617__NA

SEQ ID NO: 21392 - RNA, 1410 nt, Artificial Sequence; identical to SEQ ID NO: 19494
  derived and/or modified CDS sequence (AUadapt) from InfluenzaA__ADJ40627__NA

SEQ ID NO: 21393 - RNA, 1410 nt, Artificial Sequence; identical to SEQ ID NO: 16318
  derived and/or modified CDS sequence (AUadapt) from InfluenzaA__ADJ40637__NA

SEQ ID NO: 21394 - RNA, 1410 nt, Artificial Sequence; identical to SEQ ID NO: 16318
  derived and/or modified CDS sequence (AUadapt) from InfluenzaA__ADJ40657__NA

SEQ ID NO: 21395 - RNA, 1410 nt, Artificial Sequence; identical to SEQ ID NO: 16318
  derived and/or modified CDS sequence (AUadapt) from InfluenzaA__ADJ40667__NA

SEQ ID NO: 21396 - RNA, 1410 nt, Artificial Sequence; identical to SEQ ID NO: 16318
  derived and/or modified CDS sequence (AUadapt) from InfluenzaA__ADJ40677__NA

SEQ ID NO: 21397 - RNA, 1410 nt, Artificial Sequence
  derived and/or modified CDS sequence (AUadapt) from InfluenzaA__ADJ41819__NA
augaaccccaaccagaagaucaucaccaucggcucggugucccugaccaucgccacgaucugcuuccucaugcagaucgccauccuggucaccaccgugacccugcacuucaagcaguacgagugcagcuccccgcccaacaaccaggugguccccugcgagcccaucaucaucgagcgcaacaucacggagaucguguaccucaccaacaccaccaucgagaaggagaucugcccgaagcugguggaguaccggaacuggucgaagccccagugcaagaucacgggguucgcgcccuucuccaaggacaacagcauccgccuguccgccggcggggacaucugggucacccgggagcccuacgugucgugcgacccgggcaagugcuaccaguucgcccucgggcagggcaccacccuggacaacaagcacuccaacgacacgauccacgaccgcacccccuaccggacccugcucaugaacgagcugggcgugcccuuccaccuggggacccgccaggucugcaucgccuggagcuccucguccugccacgacggcaaggccuggcuccacgugugcaucacgggguacgacaagaacgcgaccgccagcuucaucuacgacggccggcugguggacuccaucgggucgugguccaagaacauccugcgcacccaggagagcgagugcgucugcaucaacgggaccugcacgguggugaugaccgacggcuccgccucggagcgggccgacaccaagauccucuucaucgaggagggcaagaucguccacaucagcccccuguccggcucggcgcagcacguggaggagugcuccugcuacccgcgcuaccccggggugcggugcgucugccgcgacaacuggaagggcagcaaccggcccgugguggacaucaacgucaaggacuacuccaucgugucguccuacgugugcagcggccuggucggggacacgccccgcaagaacgaccgguccucguccagcuacugccgcaacccgaacaacgagaagggcaaccacggggugaagggcugggccuucgacgacgggaacgacgucuggaugggccggaccaucuccgaggagucgcgcuccggcuacgagaccuucaaggugaucgggggcuggagcacccccaacuccaagcuccagaucaaccgccaggugaucgucgacucggggaaccgguccggcuacagcgggaucuucucgguggagggcaaguccugcaucaaccggugcuucuacguggagcugauccgcggccgcgagcaggagacccgggucugguggacgagcaacuccaucgugguguucugcgggaccagcggcaccuacgggaccggcuccuggcccgacggggccgacaucaaccugaugcccaucuga

SEQ ID NO: 21398 - RNA, 1410 nt, Artificial Sequence; identical to SEQ ID NO: 16318
  derived and/or modified CDS sequence (AUadapt) from InfluenzaA__ADJ56642__NA

SEQ ID NO: 21399 - RNA, 1410 nt, Artificial Sequence; identical to SEQ ID NO: 16318
  derived and/or modified CDS sequence (AUadapt) from InfluenzaA__ADJ56652__NA

SEQ ID NO: 21400 - RNA, 1410 nt, Artificial Sequence; identical to SEQ ID NO: 16318
  derived and/or modified CDS sequence (AUadapt) from InfluenzaA__ADJ80637__NA

SEQ ID NO: 21401 - RNA, 1410 nt, Artificial Sequence; identical to SEQ ID NO: 20158
  derived and/or modified CDS sequence (AUadapt) from InfluenzaA__ADJ80647__NA

SEQ ID NO: 21402 - RNA, 1410 nt, Artificial Sequence; identical to SEQ ID NO: 20158
  derived and/or modified CDS sequence (AUadapt) from InfluenzaA__ADJ80657__NA

SEQ ID NO: 21403 - RNA, 1410 nt, Artificial Sequence; identical to SEQ ID NO: 16318
  derived and/or modified CDS sequence (AUadapt) from InfluenzaA__ADJ80667__NA

SEQ ID NO: 21404 - RNA, 1410 nt, Artificial Sequence; identical to SEQ ID NO: 21053
  derived and/or modified CDS sequence (AUadapt) from InfluenzaA__ADJ80677__NA

SEQ ID NO: 21405 - RNA, 1410 nt, Artificial Sequence; identical to SEQ ID NO: 20428
  derived and/or modified CDS sequence (AUadapt) from InfluenzaA__ADJ80687__NA

SEQ ID NO: 21406 - RNA, 1410 nt, Artificial Sequence
  derived and/or modified CDS sequence (AUadapt) from InfluenzaA__ADJ80697__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucaucuccgugaagcuggccgggaacucgucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21407 - RNA, 1410 nt, Artificial Sequence
  derived and/or modified CDS sequence (AUadapt) from InfluenzaA__ADJ80717__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccguguacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21408 - RNA, 1410 nt, Artificial Sequence
  derived and/or modified CDS sequence (AUadapt) from InfluenzaA__ADJ80727__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggugaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21409 - RNA, 1410 nt, Artificial Sequence; identical to SEQ ID NO: 19907
  derived and/or modified CDS sequence (AUadapt) from InfluenzaA__ADJ80737__NA

SEQ ID NO: 21410 - RNA, 1410 nt, Artificial Sequence
  derived and/or modified CDS sequence (AUadapt) from InfluenzaA__ADJ80747__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggucguccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagcgggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcaucuucggggacaacccgcgccccaacgacaagaagggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggagaucaacgaguggucgggguacuccggcagcuucgugcagcacccggagcugaccgggcuggacugcauccggcccugcuucugggucgagcucauccgcggccggcccaaggagaacacgaucuggaccuccggcagcuccaucagcuucugcggggugaacuccgacaccgucggcuggagcuggcccgacggggccgagcugccguucaccaucgacaaguga

SEQ ID NO: 21411 - RNA, 1410 nt, Artificial Sequence; identical to SEQ ID NO: 16318
  derived and/or modified CDS sequence (AUadapt) from InfluenzaA__ADJ80757__NA

SEQ ID NO: 21412 - RNA, 1410 nt, Artificial Sequence; identical to SEQ ID NO: 16318
  derived and/or modified CDS sequence (AUadapt) from InfluenzaA__ADJ80767__NA

SEQ ID NO: 21413 - RNA, 1410 nt, Artificial Sequence; identical to SEQ ID NO: 19723
  derived and/or modified CDS sequence (AUadapt) from InfluenzaA__ADJ80777__NA

SEQ ID NO: 21414 - RNA, 1410 nt, Artificial Sequence; identical to SEQ ID NO: 16318
  derived and/or modified CDS sequence (AUadapt) from InfluenzaA__ADJ80787__NA

SEQ ID NO: 21415 - RNA, 1410 nt, Artificial Sequence
  derived and/or modified CDS sequence (AUadapt) from InfluenzaA__ADJ80797__NA
augaaccccaaccagaagaucaucaccaucggcucggugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaagggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 21416 - RNA, 1410 nt, Artificial Sequence; identical to SEQ ID NO: 20158
  derived and/or modified CDS sequence (AUadapt) from InfluenzaA__ADJ80807__NA

SEQ ID NO: 21417 - RNA, 1410 nt, Artificial Sequence; identical to SEQ ID NO: 16318
  derived and/or modified CDS sequence (AUadapt) from InfluenzaA__ADJ80817__NA

SEQ ID NO: 21418 - RNA, 1410 nt, Artificial Sequence; identical to SEQ ID NO: 16318
  derived and/or modified CDS sequence (AUadapt) from InfluenzaA__ADJ80827__NA

SEQ ID NO: 21419 - RNA, 1410 nt, Artificial Sequence; identical to SEQ ID NO: 20653
  derived and/or modified CDS sequence (AUadapt) from InfluenzaA__ADJ80837__NA

SEQ ID NO: 21420 - RNA, 1410 nt, Artificial Sequence; identical to SEQ ID NO: 21151
  derived and/or modified CDS sequence (AUadapt) from InfluenzaA__ADJ80851__NA

SEQ ID NO: 21421 - RNA, 1410 nt, Artificial Sequence
  derived and/or modified CDS sequence (AUadapt) from InfluenzaA__ADJ80861__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugucccccaacggggccaacggcgugaagggguucucguucaaguacggcaacggggucuggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucgugcagcaccccgagcugacgggccuggacugcauccgccccugcuucugggucgagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 21422 - RNA, 1410 nt, Artificial Sequence; identical to SEQ ID NO: 21415
  derived and/or modified CDS sequence (AUadapt) from InfluenzaA__ADJ80871__NA

SEQ ID NO: 21423 - RNA, 1410 nt, Artificial Sequence; identical to SEQ ID NO: 16318
  derived and/or modified CDS sequence (AUadapt) from InfluenzaA__ADJ80886__NA

SEQ ID NO: 21424 - RNA, 1410 nt, Artificial Sequence
  derived and/or modified CDS sequence (AUadapt) from InfluenzaA__ADJ80896__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcugaccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgaggugcccucccccuacaacagccgguucgagagcgucgccugguccgccagcgcgugccacgacgggaucaacuggcucaccaucggcaucuccggccccgacaacggggccguggccgugcugaaguacaacggcaucaucaccgacacgaucaagagcuggcgcaacaacauccugcggacccaggaguccgagugcgccugcgucaacgggucgugcuucaccgugaugaccgacggcccguccgacggccaggcgagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcacggacaacaacuucucgaucaagcaggacaucgucgggaucaacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 21425 - RNA, 1410 nt, Artificial Sequence
  derived and/or modified CDS sequence (AUadapt) from InfluenzaA__ADJ80913__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggagcuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaagggcuccugcggccccgugagcuccaacggggccaacggcgugaagggguucagcuucaaguacggcaacggggucuggaucggccgcaccaagagcaucuccucgcgguccggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 21426 - RNA, 1410 nt, Artificial Sequence; identical to SEQ ID NO: 16318
  derived and/or modified CDS sequence (AUadapt) from InfluenzaA__ADJ80930__NA

SEQ ID NO: 21427 - RNA, 1410 nt, Artificial Sequence; identical to SEQ ID NO: 16318
  derived and/or modified CDS sequence (AUadapt) from InfluenzaA__ADJ80950__NA

SEQ ID NO: 21428 - RNA, 1410 nt, Artificial Sequence; identical to SEQ ID NO: 20428
  derived and/or modified CDS sequence (AUadapt) from InfluenzaA__ADJ80960__NA

SEQ ID NO: 21429 - RNA, 1410 nt, Artificial Sequence; identical to SEQ ID NO: 21415
  derived and/or modified CDS sequence (AUadapt) from InfluenzaA__ADJ80970__NA

SEQ ID NO: 21430 - RNA, 1410 nt, Artificial Sequence; identical to SEQ ID NO: 16318
  derived and/or modified CDS sequence (AUadapt) from InfluenzaA__ADJ80980__NA

SEQ ID NO: 21431 - RNA, 1410 nt, Artificial Sequence; identical to SEQ ID NO: 21415
  derived and/or modified CDS sequence (AUadapt) from InfluenzaA__ADJ80996__NA

SEQ ID NO: 21432 - RNA, 1410 nt, Artificial Sequence
  derived and/or modified CDS sequence (AUadapt) from InfluenzaA__ADJ81006__NA
augaaccccaaccagaagaucaucaccaucggcucggugugcaugaccaucgggauggccaaccugauccuccaggucggcaacaucaucuccaucuggaucagccacuccauccagcuggggaaccagaaccagaucgagacgugcaaccagagcaucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaccagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21433 - RNA, 1410 nt, Artificial Sequence; identical to SEQ ID NO: 21151
  derived and/or modified CDS sequence (AUadapt) from InfluenzaA__ADJ81016__NA

SEQ ID NO: 21434 - RNA, 1410 nt, Artificial Sequence; identical to SEQ ID NO: 21340
  derived and/or modified CDS sequence (AUadapt) from InfluenzaA__ADJ81026__NA

SEQ ID NO: 21435 - RNA, 1410 nt, Artificial Sequence; identical to SEQ ID NO: 16318
  derived and/or modified CDS sequence (AUadapt) from InfluenzaA__ADJ81036__NA

SEQ ID NO: 21436 - RNA, 1410 nt, Artificial Sequence
  derived and/or modified CDS sequence (AUadapt) from InfluenzaA__ADJ81046__NA
augaaccccaaccagaagaucaucaccaucggcucggugugcaugaccgucgggauggccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagucggugguguccgucaagcuggccgggaacagcucccucugcccggugagcggcugggccaucuacuccaaggacaacagcauccgcaucggcuccaagggggacguguucgucauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacucgcgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccucggagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagucgaucaacagccggaacggcuucgagaugaucugggaccccaacggguggaccggcaccgacaacaacuucuccaucaagcaggacaucguggggacgaacgaguggagcggcuacuccgggucguucguccagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 21437 - RNA, 1410 nt, Artificial Sequence
  derived and/or modified CDS sequence (AUadapt) from InfluenzaA__ADJ81056__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugccggugaagcuggccggguccucgucccucugccccgucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccgguccccguaccgcacgcugaugagcugccccaucggcgagguccccucccccuacaacagccgguucgagagcguggccugguccgcgucggccugccacgacgggaucaacuggcucaccaucggcaucuccggcccggacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgcccgugggucagcuucaaccagaaccucgaguaccagaucggguacaucugcuccggcaucuucggggacaacccccggcccaacgacaagaagggcagcugcggccccguguccucgaacggggccaacggcgugaagggguucuccuucaaguacggcaacggggucuggaucggccgcaccaagagcaucaacagccggaacggcuucgagaugaucugggacccgaacggguggaccggcaccgacaacaacuucuccaucaagcaggacaucguggggaucaacgaguggagcggcuacuccgggucguucgugcagcaccccgagcugaccggccuggacugcauccgccccugcuucugggucgagcucauccggggccgccccaaggagaacacgaucuggaccuccgggagcuccaucagcuucugcggcgugaacuccgacaccgucggguggagcuggccggacggcgccgagcugcccuucaccaucgacaaguga

SEQ ID NO: 21438 - RNA, 1410 nt, Artificial Sequence; identical to SEQ ID NO: 20428
  derived and/or modified CDS sequence (AUadapt) from InfluenzaA__ADJ81066__NA

SEQ ID NO: 21439 - RNA, 1410 nt, Artificial Sequence; identical to SEQ ID NO: 19001
  derived and/or modified CDS sequence (AUadapt) from InfluenzaA__ADJ84775__NA

SEQ ID NO: 21440 - RNA, 1410 nt, Artificial Sequence
  derived and/or modified CDS sequence (AUadapt) from InfluenzaA__ADJ88785__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccgucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccacaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggcccgacggcgccgaccugaaccucaugccgaucuga

SEQ ID NO: 21441 - RNA, 1410 nt, Artificial Sequence; identical to SEQ ID NO: 16318
  derived and/or modified CDS sequence (AUadapt) from InfluenzaA__ADK21716__NA

SEQ ID NO: 21442 - RNA, 1410 nt, Artificial Sequence; identical to SEQ ID NO: 16318
  derived and/or modified CDS sequence (AUadapt) from InfluenzaA__ADK21726__NA

SEQ ID NO: 21443 - RNA, 1410 nt, Artificial Sequence; identical to SEQ ID NO: 16318
  derived and/or modified CDS sequence (AUadapt) from InfluenzaA__ADK21736__NA

SEQ ID NO: 21444 - RNA, 1410 nt, Artificial Sequence
  derived and/or modified CDS sequence (AUadapt) from InfluenzaA__ADK21746__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagcacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggagcggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccgaggagaacaccaucuggaccuccgggagcuccaucagcuucugcggcgucaacuccgacaccgugggguggagcuggcccgacggcgccgagcugccguucacgaucgacaaguga

SEQ ID NO: 21445 - RNA, 1410 nt, Artificial Sequence; identical to SEQ ID NO: 16318
  derived and/or modified CDS sequence (AUadapt) from InfluenzaA__ADK21756__NA

SEQ ID NO: 21446 - RNA, 1410 nt, Artificial Sequence; identical to SEQ ID NO: 16318
  derived and/or modified CDS sequence (AUadapt) from InfluenzaA__ADK21766__NA

SEQ ID NO: 21447 - RNA, 1410 nt, Artificial Sequence; identical to SEQ ID NO: 20571
  derived and/or modified CDS sequence (AUadapt) from InfluenzaA__ADK21776__NA

SEQ ID NO: 21448 - RNA, 1410 nt, Artificial Sequence; identical to SEQ ID NO: 16318
  derived and/or modified CDS sequence (AUadapt) from InfluenzaA__ADK21786__NA

SEQ ID NO: 21449 - RNA, 1410 nt, Artificial Sequence; identical to SEQ ID NO: 16318
  derived and/or modified CDS sequence (AUadapt) from InfluenzaA__ADK21796__NA

SEQ ID NO: 21450 - RNA, 1410 nt, Artificial Sequence; identical to SEQ ID NO: 16318
  derived and/or modified CDS sequence (AUadapt) from InfluenzaA__ADK21806__NA

SEQ ID NO: 21451 - RNA, 1410 nt, Artificial Sequence; identical to SEQ ID NO: 16318
  derived and/or modified CDS sequence (AUadapt) from InfluenzaA__ADK21816__NA

SEQ ID NO: 21452 - RNA, 1410 nt, Artificial Sequence; identical to SEQ ID NO: 21118
  derived and/or modified CDS sequence (AUadapt) from InfluenzaA__ADK21826__NA

SEQ ID NO: 21453 - RNA, 1410 nt, Artificial Sequence; identical to SEQ ID NO: 21031
  derived and/or modified CDS sequence (AUadapt) from InfluenzaA__ADK21836__NA

SEQ ID NO: 21454 - RNA, 1410 nt, Artificial Sequence
  derived and/or modified CDS sequence (AUadapt) from InfluenzaA__ADK21846__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaugaagcaggacaucguggggaucaacgagugguccggcuacagcggguccuucgugcagcacccggagcugacgggccuggacugcauccgccccugcuucugggucgagcucauccggggccgccccaaggagaacaccaucugggccagcggguccagcaucuccuucugcggcgugaacagcgacaccgucgggugguccuggcccgacggcgcggagcugccguucaccaucgacaaguga

SEQ ID NO: 21455 - RNA, 1410 nt, Artificial Sequence; identical to SEQ ID NO: 16318
  derived and/or modified CDS sequence (AUadapt) from InfluenzaA__ADK21856__NA

SEQ ID NO: 21456 - RNA, 1410 nt, Artificial Sequence; identical to SEQ ID NO: 16318
  derived and/or modified CDS sequence (AUadapt) from InfluenzaA__ADK21866__NA

SEQ ID NO: 21457 - RNA, 1410 nt, Artificial Sequence; identical to SEQ ID NO: 16318
  derived and/or modified CDS sequence (AUadapt) from InfluenzaA__ADK21876__NA

SEQ ID NO: 21458 - RNA, 1410 nt, Artificial Sequence; identical to SEQ ID NO: 16318
  derived and/or modified CDS sequence (AUadapt) from InfluenzaA__ADK21886__NA

SEQ ID NO: 21459 - RNA, 1410 nt, Artificial Sequence
  derived and/or modified CDS sequence (AUadapt) from InfluenzaA__ADK21896__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugagcuccgacacggucggguggagcuggcccgacggcgccgagcugccguucaccaucgacaaguga

SEQ ID NO: 21460 - RNA, 1410 nt, Artificial Sequence
  derived and/or modified CDS sequence (AUadapt) from InfluenzaA__ADK21906__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccuggaucagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucggcagccggaacggguucgagaugaucugggaccccaacggcuggaccgggaccgacaacaacuucuccaucaagcaggacaucgucggcaucaacgaguggagcggguacuccggcucguucgugcagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 21461 - RNA, 1410 nt, Artificial Sequence; identical to SEQ ID NO: 16318
  derived and/or modified CDS sequence (AUadapt) from InfluenzaA__ADK21916__NA

SEQ ID NO: 21462 - RNA, 1410 nt, Artificial Sequence; identical to SEQ ID NO: 16318
  derived and/or modified CDS sequence (AUadapt) from InfluenzaA__ADK21926__NA

SEQ ID NO: 21463 - RNA, 1410 nt, Artificial Sequence; identical to SEQ ID NO: 16318
  derived and/or modified CDS sequence (AUadapt) from InfluenzaA__ADK21936__NA

SEQ ID NO: 21464 - RNA, 1410 nt, Artificial Sequence
  derived and/or modified CDS sequence (AUadapt) from InfluenzaA__ADK21946__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggcauggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21465 - RNA, 1410 nt, Artificial Sequence
  derived and/or modified CDS sequence (AUadapt) from InfluenzaA__ADK21956__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuucaagaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcaacaccgucgggugguccuggcccgacggcgccgagcugccguucacgaucgacaaguga

SEQ ID NO: 21466 - RNA, 1410 nt, Artificial Sequence; identical to SEQ ID NO: 16318
  derived and/or modified CDS sequence (AUadapt) from InfluenzaA__ADK32393__NA

SEQ ID NO: 21467 - RNA, 1410 nt, Artificial Sequence; identical to SEQ ID NO: 16318
  derived and/or modified CDS sequence (AUadapt) from InfluenzaA__ADK32403__NA

SEQ ID NO: 21468 - RNA, 1410 nt, Artificial Sequence; identical to SEQ ID NO: 16318
  derived and/or modified CDS sequence (AUadapt) from InfluenzaA__ADK32413__NA

SEQ ID NO: 21469 - RNA, 1410 nt, Artificial Sequence
  derived and/or modified CDS sequence (AUadapt) from InfluenzaA__ADK32423__NA
augaaccccaaccagaagaucaucaccaucggcucggugugcaugaccaucgggaugacgaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgccggccagagcgucguguccgugaagcuggcggggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccgacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21470 - RNA, 1410 nt, Artificial Sequence; identical to SEQ ID NO: 16318
  derived and/or modified CDS sequence (AUadapt) from InfluenzaA__ADK32433__NA

SEQ ID NO: 21471 - RNA, 1410 nt, Artificial Sequence; identical to SEQ ID NO: 16318
  derived and/or modified CDS sequence (AUadapt) from InfluenzaA__ADK32443__NA

SEQ ID NO: 21472 - RNA, 1410 nt, Artificial Sequence
  derived and/or modified CDS sequence (AUadapt) from InfluenzaA__ADK32453__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugucggggaacuccagccucugcccggucuccggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacagccgguucgaguccguggccuggagcgccuccgcgugccacgacgggaucaacuggcucaccaucggcaucagcggccccgacaacggggccgucgccgugcugaaguacaacggcaucaucaccgacaccaucaaguccuggcgcaacaacauccugcggacgcaggagucggagugcgccugcgugaacggguccugcuucaccgucaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 21473 - RNA, 1410 nt, Artificial Sequence
  derived and/or modified CDS sequence (AUadapt) from InfluenzaA__ADK32463__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccucaucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21474 - RNA, 1410 nt, Artificial Sequence; identical to SEQ ID NO: 16318
  derived and/or modified CDS sequence (AUadapt) from InfluenzaA__ADK32473__NA

SEQ ID NO: 21475 - RNA, 1410 nt, Artificial Sequence; identical to SEQ ID NO: 16318
  derived and/or modified CDS sequence (AUadapt) from InfluenzaA__ADK32483__NA

SEQ ID NO: 21476 - RNA, 1410 nt, Artificial Sequence; identical to SEQ ID NO: 16318
  derived and/or modified CDS sequence (AUadapt) from InfluenzaA__ADK32493__NA

SEQ ID NO: 21477 - RNA, 1410 nt, Artificial Sequence; identical to SEQ ID NO: 21053
  derived and/or modified CDS sequence (AUadapt) from InfluenzaA__ADK32505__NA

SEQ ID NO: 21478 - RNA, 1410 nt, Artificial Sequence
  derived and/or modified CDS sequence (AUadapt) from InfluenzaA__ADK32640__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 21479 - RNA, 1410 nt, Artificial Sequence; identical to SEQ ID NO: 16318
  derived and/or modified CDS sequence (AUadapt) from InfluenzaA__ADK32650__NA

SEQ ID NO: 21480 - RNA, 1410 nt, Artificial Sequence; identical to SEQ ID NO: 16318
  derived and/or modified CDS sequence (AUadapt) from InfluenzaA__ADK32660__NA

SEQ ID NO: 21481 - RNA, 1410 nt, Artificial Sequence; identical to SEQ ID NO: 16318
  derived and/or modified CDS sequence (AUadapt) from InfluenzaA__ADK32670__NA

SEQ ID NO: 21482 - RNA, 1410 nt, Artificial Sequence
  derived and/or modified CDS sequence (AUadapt) from InfluenzaA__ADK32680__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacaagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21483 - RNA, 1410 nt, Artificial Sequence; identical to SEQ ID NO: 16318
  derived and/or modified CDS sequence (AUadapt) from InfluenzaA__ADK32690__NA

SEQ ID NO: 21484 - RNA, 1410 nt, Artificial Sequence; identical to SEQ ID NO: 16318
  derived and/or modified CDS sequence (AUadapt) from InfluenzaA__ADK32700__NA

SEQ ID NO: 21485 - RNA, 1410 nt, Artificial Sequence; identical to SEQ ID NO: 16318
  derived and/or modified CDS sequence (AUadapt) from InfluenzaA__ADK32779__NA

SEQ ID NO: 21486 - RNA, 1410 nt, Artificial Sequence; identical to SEQ ID NO: 16318
  derived and/or modified CDS sequence (AUadapt) from InfluenzaA__ADK33614__NA

SEQ ID NO: 21487 - RNA, 1410 nt, Artificial Sequence; identical to SEQ ID NO: 16318
  derived and/or modified CDS sequence (AUadapt) from InfluenzaA__ADK33624__NA

SEQ ID NO: 21488 - RNA, 1410 nt, Artificial Sequence; identical to SEQ ID NO: 16318
  derived and/or modified CDS sequence (AUadapt) from InfluenzaA__ADK33634__NA

SEQ ID NO: 21489 - RNA, 1410 nt, Artificial Sequence
  derived and/or modified CDS sequence (AUadapt) from InfluenzaA__ADK33644__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggcagcgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 21490 - RNA, 1410 nt, Artificial Sequence; identical to SEQ ID NO: 20871
  derived and/or modified CDS sequence (AUadapt) from InfluenzaA__ADK33654__NA

SEQ ID NO: 21491 - RNA, 1410 nt, Artificial Sequence; identical to SEQ ID NO: 20871
  derived and/or modified CDS sequence (AUadapt) from InfluenzaA__ADK33664__NA

SEQ ID NO: 21492 - RNA, 1410 nt, Artificial Sequence; identical to SEQ ID NO: 16318
  derived and/or modified CDS sequence (AUadapt) from InfluenzaA__ADK33674__NA

SEQ ID NO: 21493 - RNA, 1410 nt, Artificial Sequence; identical to SEQ ID NO: 16318
  derived and/or modified CDS sequence (AUadapt) from InfluenzaA__ADK33684__NA

SEQ ID NO: 21494 - RNA, 1410 nt, Artificial Sequence; identical to SEQ ID NO: 20491
  derived and/or modified CDS sequence (AUadapt) from InfluenzaA__ADK33694__NA

SEQ ID NO: 21495 - RNA, 1410 nt, Artificial Sequence; identical to SEQ ID NO: 16318
  derived and/or modified CDS sequence (AUadapt) from InfluenzaA__ADK33704__NA

SEQ ID NO: 21496 - RNA, 1410 nt, Artificial Sequence; identical to SEQ ID NO: 16318
  derived and/or modified CDS sequence (AUadapt) from InfluenzaA__ADK33714__NA

SEQ ID NO: 21497 - RNA, 1410 nt, Artificial Sequence; identical to SEQ ID NO: 16318
  derived and/or modified CDS sequence (AUadapt) from InfluenzaA__ADK33744__NA

SEQ ID NO: 21498 - RNA, 1410 nt, Artificial Sequence
  derived and/or modified CDS sequence (AUadapt) from InfluenzaA__ADK33754__NA
augaaccccaaccagaagaucaucaccaucggcucggugugcaugaccaucgggauggccaacuucauccugcagaucggcaacaucaucuccaucuggaucagccacuccauccagcucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21499 - RNA, 1410 nt, Artificial Sequence
  derived and/or modified CDS sequence (AUadapt) from InfluenzaA__ADK33764__NA
augaaccccaaccagaagaucaucaccaucggcucggugugcaugaccaucgggauggccaacuucauccugcagaucggcaacaucaucuccaucuggaucagccacuccauccagcucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaugggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21500 - RNA, 1410 nt, Artificial Sequence
  derived and/or modified CDS sequence (AUadapt) from InfluenzaA__ADK33774__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaugggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21501 - RNA, 1410 nt, Artificial Sequence; identical to SEQ ID NO: 20114
  derived and/or modified CDS sequence (AUadapt) from InfluenzaA__ADK33784__NA

SEQ ID NO: 21502 - RNA, 1410 nt, Artificial Sequence; identical to SEQ ID NO: 16318
  derived and/or modified CDS sequence (AUadapt) from InfluenzaA__ADK33794__NA

SEQ ID NO: 21503 - RNA, 1410 nt, Artificial Sequence; identical to SEQ ID NO: 16318
  derived and/or modified CDS sequence (AUadapt) from InfluenzaA__ADK33804__NA

SEQ ID NO: 21504 - RNA, 1410 nt, Artificial Sequence
  derived and/or modified CDS sequence (AUadapt) from InfluenzaA__ADK33814__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaacaagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaugggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21505 - RNA, 1410 nt, Artificial Sequence
  derived and/or modified CDS sequence (AUadapt) from InfluenzaA__ADK33824__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacaucaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21506 - RNA, 1410 nt, Artificial Sequence; identical to SEQ ID NO: 20317
  derived and/or modified CDS sequence (AUadapt) from InfluenzaA__ADK33834__NA

SEQ ID NO: 21507 - RNA, 1410 nt, Artificial Sequence
  derived and/or modified CDS sequence (AUadapt) from InfluenzaA__ADK33844__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgccaagcuggccgggaacagcccgcucugccccguguccggcugggccaucuacagcaaggacaacuccauccgcaucggcagcaagggggacgucuucgugauccgggagcccuucaucuccugcucgccccuggagugccgcaccuucuuccugacccagggcgcccuccugaacgacaagcacuccaacgggaccaucaaggaccggagcccguaccgcacgcugauguccugccccaucggcgaggugcccagccccuacaacucccgguucgagucggucgcguggagcgccuccgccugccacgacgggaucaacuggcucaccaucggcaucagcggcccggacaacggggccguggcggugcugaaguacaacggcaucaucaccgacaccaucaaguccuggcgcaacaacauccugcggacgcaggagagcgagugcgccugcgucaacggguccugcuucaccgugaugaccgacggccccucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgcccguggguguccuucaaccagaaccucgaguaccagaucggguacaucugcagcggcaucuucggggacaacccccggcccaacgacaagaccggcuccugcggccccgucagcuccaacggggccaacggcgugaagggguucagcuucaaguacggcaacgggguguggaucggccgcaccaaguccaucucgagccggaacggcuucgagaugaucugggacccgaacggguggaccggcaccgacaacaacuucuccaucaagcaggacaucgucgggaucaacgaguggagcggcuacuccgggucguucgugcagcaccccgagcugacgggccuggacugcauccgccccugcuucuggguggagcucauccggggccgccccaaggagaacaccaucuggaccuccgggagcuccaucagcuucugcggcgucaacuccgacaccgugggguggagcuggccggacggcgcggagcugcccuucacgaucgacaaguga

SEQ ID NO: 21508 - RNA, 1410 nt, Artificial Sequence; identical to SEQ ID NO: 20317
  derived and/or modified CDS sequence (AUadapt) from InfluenzaA__ADK33854__NA

SEQ ID NO: 21509 - RNA, 1410 nt, Artificial Sequence; identical to SEQ ID NO: 21031
  derived and/or modified CDS sequence (AUadapt) from InfluenzaA__ADK33864__NA

SEQ ID NO: 21510 - RNA, 1410 nt, Artificial Sequence
  derived and/or modified CDS sequence (AUadapt) from InfluenzaA__ADK33874__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguaccugugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21511 - RNA, 1410 nt, Artificial Sequence; identical to SEQ ID NO: 16318
  derived and/or modified CDS sequence (AUadapt) from InfluenzaA__ADK33884__NA

SEQ ID NO: 21512 - RNA, 1410 nt, Artificial Sequence; identical to SEQ ID NO: 20317
  derived and/or modified CDS sequence (AUadapt) from InfluenzaA__ADK33894__NA

SEQ ID NO: 21513 - RNA, 1410 nt, Artificial Sequence; identical to SEQ ID NO: 20317
  derived and/or modified CDS sequence (AUadapt) from InfluenzaA__ADK33904__NA

SEQ ID NO: 21514 - RNA, 1410 nt, Artificial Sequence; identical to SEQ ID NO: 21097
  derived and/or modified CDS sequence (AUadapt) from InfluenzaA__ADK33914__NA

SEQ ID NO: 21515 - RNA, 1410 nt, Artificial Sequence
  derived and/or modified CDS sequence (AUadapt) from InfluenzaA__ADK33924__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcaacaccgucgggugguccuggcccgacggcgccgagcugccguucacgaucgacaaguga

SEQ ID NO: 21516 - RNA, 1410 nt, Artificial Sequence; identical to SEQ ID NO: 16318
  derived and/or modified CDS sequence (AUadapt) from InfluenzaA__ADK33934__NA

SEQ ID NO: 21517 - RNA, 1410 nt, Artificial Sequence; identical to SEQ ID NO: 16318
  derived and/or modified CDS sequence (AUadapt) from InfluenzaA__ADK33944__NA

SEQ ID NO: 21518 - RNA, 1410 nt, Artificial Sequence; identical to SEQ ID NO: 21097
  derived and/or modified CDS sequence (AUadapt) from InfluenzaA__ADK33954__NA

SEQ ID NO: 21519 - RNA, 1410 nt, Artificial Sequence; identical to SEQ ID NO: 16318
  derived and/or modified CDS sequence (AUadapt) from InfluenzaA__ADK33964__NA

SEQ ID NO: 21520 - RNA, 1410 nt, Artificial Sequence; identical to SEQ ID NO: 20247
  derived and/or modified CDS sequence (AUadapt) from InfluenzaA__ADK33974__NA

SEQ ID NO: 21521 - RNA, 1410 nt, Artificial Sequence; identical to SEQ ID NO: 16318
  derived and/or modified CDS sequence (AUadapt) from InfluenzaA__ADK33984__NA

SEQ ID NO: 21522 - RNA, 1410 nt, Artificial Sequence
  derived and/or modified CDS sequence (AUadapt) from InfluenzaA__ADK39016__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccgacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21523 - RNA, 1410 nt, Artificial Sequence; identical to SEQ ID NO: 19001
  derived and/or modified CDS sequence (AUadapt) from InfluenzaA__ADK45315__NA

SEQ ID NO: 21524 - RNA, 1410 nt, Artificial Sequence
  derived and/or modified CDS sequence (AUadapt) from InfluenzaA__ADK45413__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcuguacgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggacauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgccagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccaacaucaaccugaugcccaucuga

SEQ ID NO: 21525 - RNA, 1410 nt, Artificial Sequence
  derived and/or modified CDS sequence (AUadapt) from InfluenzaA__ADK45424__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuaccugugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 21526 - RNA, 1410 nt, Artificial Sequence; identical to SEQ ID NO: 20307
  derived and/or modified CDS sequence (AUadapt) from InfluenzaA__ADK45446__NA

SEQ ID NO: 21527 - RNA, 1410 nt, Artificial Sequence
  derived and/or modified CDS sequence (AUadapt) from InfluenzaA__ADK45457__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucgggguccagccacugccucgaccccaacaacgaggagggcgggcacggcgucaaggggugggccuucgacgacggcaacgacguguggaugggccgcaccaucuccgagaagucccggcugggguacgagaccuucaaggucaucgagggcuggucgaaccccaagagcaagcugcagaucaaccgccaggugaucguggaccgggggaaccgcuccggcuacucggggaucuucuccgucgagggcaagagcugcaucaaccggugcuucuacguggagcucauccgcggccggaaggaggagaccgaggugcuguggaccucgaacuccaucgucguguucugcgggaccagcggcacguacgggaccggcuccuggccggacggggccgacaucaaccugaugcccaucuga

SEQ ID NO: 21528 - RNA, 1410 nt, Artificial Sequence
  derived and/or modified CDS sequence (AUadapt) from InfluenzaA__ADK45479__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagguggugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccacaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggaggccgagguccuguggaccuccaacagcaucgugguguucugcggcaccuccgggaccuacggcacggggagcuggcccgacggcgccgaccugaaccucaugccgaucuga

SEQ ID NO: 21529 - RNA, 1410 nt, Artificial Sequence; identical to SEQ ID NO: 16318
  derived and/or modified CDS sequence (AUadapt) from InfluenzaA__ADK48799__NA

SEQ ID NO: 21530 - RNA, 1410 nt, Artificial Sequence; identical to SEQ ID NO: 21053
  derived and/or modified CDS sequence (AUadapt) from InfluenzaA__ADK62686__NA

SEQ ID NO: 21531 - RNA, 1410 nt, Artificial Sequence; identical to SEQ ID NO: 20491
  derived and/or modified CDS sequence (AUadapt) from InfluenzaA__ADK62696__NA

SEQ ID NO: 21532 - RNA, 1410 nt, Artificial Sequence; identical to SEQ ID NO: 19723
  derived and/or modified CDS sequence (AUadapt) from InfluenzaA__ADK64994__NA

SEQ ID NO: 21533 - RNA, 1410 nt, Artificial Sequence
  derived and/or modified CDS sequence (AUadapt) from InfluenzaA__ADK65002__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaccggcuccaagggggacguguucgugauccgggagcccuucaucucgugcagcccccuggagugccgcaccuucuuccugacccagggcgcccuccugaacgacaagcacuccaacgggacgaucaaggaccggucccccuaccgcacccugaugagcugcccgaucggcgagguccccucccccuacaacucgcgguucgagagcguggccugguccgcgagcgccugccacgacgggaucaacuggcucaccaucggcaucuccggccccgacaacggggccguggccggccugaaguacaacgggaucaucaccgacacgaucaagagcuggcgcaacaacauccugcggacccaggaguccgagugcgcgugcgucaacggcucgugcuucaccgugaugaccgacggcccguccgacgggcaggccagcuacaagaucuuccgcaucgagaagggcaagaucgugaaguccgucgagaugaacgcccccaacuaccacuacgaggagugcagcugcuaccccgacuccucggagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagucgaucagcucccggaacggguucgagaugaucugggaccccaacggcuggaccgggacggacaacaacuucagcaucaagcaggacaucgucggcaucaacgagugguccggguacucgggcuccuucgugcagcacccggagcugaccggccuggacugcauccgccccugcuucuggguggagcucauccgggggcgccccaaggagaacaccaucuggaccagcggcuccagcaucuccuucugcggggucaacagcgacacggugggcugguccuggcccgacggcgccgagcugccguucaccaucgacaaguga

SEQ ID NO: 21534 - RNA, 1410 nt, Artificial Sequence; identical to SEQ ID NO: 16318
  derived and/or modified CDS sequence (AUadapt) from InfluenzaA__ADK65010__NA

SEQ ID NO: 21535 - RNA, 1410 nt, Artificial Sequence
  derived and/or modified CDS sequence (AUadapt) from InfluenzaA__ADK65018__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacagcaacgggaccaucaaggaccggucccccuaccgcacgcugaugagcugcccgaucggcgagguccccucccccuacaacagccgguucgagucgguggccuggcccgcguccgccugccacgacgggaucaacuggcucaccaucggcaucagcggcccggacaacggggccguggccguccugaaguacaacggcaucaucaccgacaccaucaaguccuggcgcaacaacauccugcggacgcaggagagcgagugcgcgugcgugaacggguccugcuucaccaucaugaccgacggccccagcgacggccaggccuccuacaagaucuuccgcaucgagaaggggaagaucgugaaguccaucgagaugaacgcccccaacuaccacuacgaggagugcuccugcuaccccgacucguccgagaucacgugcgucugccgggacaacuggcacggcagcaaccgcccguggguguccuucaaccagaaccucgaguaccagaucggguacaucugcagcggcaucuucggggacaacccccggcccaacgacaagaccggcuccugcggccccgugagcuccaacggggccaacggcgucaagggguucucguucaaguacggcaacgggguguggaucggccgcaccaaguccaucagcagccggaacggcuucgagaugaucugggacccgaacggguggaccggcaccgacaacaacuucuccaucaagcaggacaucguggggaucaacgaguggagcggcuacuccgggucguucguccagcaccccgagcugacgggccuggacugcauccgccccugcuucuggguggagcucauccggggccgccccaaggagaacaccaucuggaccuccgggagcuccaucagcuucugcggcgugaacuccgacaccgucggguggagcuggccggacggcgccgagcugcccuucacgaucgacaaguga

SEQ ID NO: 21536 - RNA, 1410 nt, Artificial Sequence
  derived and/or modified CDS sequence (AUadapt) from InfluenzaA__ADK87290__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccuacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccguguga

SEQ ID NO: 21537 - RNA, 1410 nt, Artificial Sequence
  derived and/or modified CDS sequence (AUadapt) from InfluenzaA__ADK87292__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgccugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccguguga

SEQ ID NO: 21538 - RNA, 1410 nt, Artificial Sequence
  derived and/or modified CDS sequence (AUadapt) from InfluenzaA__ADK87294__NA
augaaccccaaccagaagaucaucgccaucggcucggugucccugaccaucucgaccaucugcuucuuccuccagaucgccauccugaucacgaccgucacccugcacuucaagcaguacgaguucaacuccccgcccaacaaccaggugaugcucugcgagcccaccaucaucgagcgcaacaucacggagaucguguaccugaccaacaccaccaucgagaaggagaucugccccaagcuggcggaguaccggaacuggagcaagccgcagugcgacaucacgggguucgcccccuucuccaaggacaacucgauccgccucuccgccggcggggacaucugggucacccgggagcccuacgugagcugcgaccccgacaagugcuaccaguucgcccugggccaggggaccacccugaacaacgugcacuccaacaacacgguccgcgaccggaccccguaccgcacccuccugaugaacgagcugggcgugcccuuccaccucggcaccaagcaggucugcaucgccuggucguccagcuccugccgggacgggaaggcguggcugcacgugugcaucacgggcgacgacaagaacgccaccgccucguucaucuacaacgggcgccugguggacuccguggucagcugguccaaggagauccuccggacccaggagucggagugcgugugcaucaacgggaccugcacgguggucaugaccgacggcuccgccagcggcaaggcggacaccaagauccuguucaucgaggagggcaagaucgugcacaccucgacgcuguccgggucggcccagcacguggaggagugcuccugcuacccccgcuaccccggcguccggugcgugugccgcgacaccgggaagggcagcaaccggccgaucguggacaucaacaucaaggaccacuccaucgucucguccuacgugugcagcggccucgugggggacacgccccgcaagaacgacuccucguccagcucccacugccuggaccccaacaacgaggagggcgggcacggcgucaaggggugggccuucgacgacggcaacgacguguggaugggccggaccaucucggagaagucccgccugggguacgagaccuucaaggucaucgagggcuggagcaaccccaaguccaagcuccagaucaaccgccaggugaucguggaccgggggaaccggucgggcuacuccgggaucuucagcgucgagggcaagucgugcaucaaccgcugcuucuacguggagcugauccggggccgcaaggaggagaccgaggugcuguggaccuccaacaacaucgucguguucugcgggaccagcggcacguacgggaccggcuccuggccggacggggccgacaucaaccucaugcccguguga

SEQ ID NO: 21539 - RNA, 1410 nt, Artificial Sequence
  derived and/or modified CDS sequence (AUadapt) from InfluenzaA__ADK87297__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaagaaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21540 - RNA, 1410 nt, Artificial Sequence
  derived and/or modified CDS sequence (AUadapt) from InfluenzaA__ADK87299__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuucaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21541 - RNA, 1410 nt, Artificial Sequence
  derived and/or modified CDS sequence (AUadapt) from InfluenzaA__ADK87301__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggccaugaccgacggguccgccagcggcaaggcggacaccaagauccucuucaucgaggagggcaagaucguccacacgucgacccuguccgggagcgcccagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 21542 - RNA, 1410 nt, Artificial Sequence; identical to SEQ ID NO: 19001
  derived and/or modified CDS sequence (AUadapt) from InfluenzaA__ADK87303__NA

SEQ ID NO: 21543 - RNA, 1410 nt, Artificial Sequence
  derived and/or modified CDS sequence (AUadapt) from InfluenzaA__ADK87305__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucgugggccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccguguga

SEQ ID NO: 21544 - RNA, 1410 nt, Artificial Sequence
  derived and/or modified CDS sequence (AUadapt) from InfluenzaA__ADK87307__NA
augaaccccaaccagaaggugaucaccaucggcucggucucccugaccaucagcacgaucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucggccgggggaaccgcucgggcuacuccgggaucuucagcguggagggcaagucgugcaucaaccggugcuucuacguggagcucaucggcgggcgcaaggaggagaccgagguccuguggaccuccaacagcaucgugguguucugcggcaccuccgggacguacggcaccgggagcuggccggacggcgccgacaucaaccugaugcccgucuga

SEQ ID NO: 21545 - RNA, 1410 nt, Artificial Sequence
  derived and/or modified CDS sequence (AUadapt) from InfluenzaA__ADK87312__NA
augaaccccaaccagaccaucaucaccaucggcucggugugcaugacgaucgggauggccaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucaucuccgugaagcuggccgggaacucgucccucugcccggugagcggcugggccaucuacuccaaggacaacaacauccgcaucggcagcaagggggacgucuucgugauccgggagcccuucaucuccugcagcccccuggagugccgcaccuucuuccugacccagggcgcccuccugaacgacaagcacuccaacgggacgaucaaggaccggucgcccuaccgcacccugauguccugcccgaucggcgaggugcccagccccuacaacucccgguucgagagcgucgccuggagcgcguccgccugccacgacgggaucaacuggcucaccaucggcaucucgggccccgacaacggggccguggccgugcugaaguacaacggcaucaucaccgacacgaucaaguccuggcgcaacaacauccugcggacccaggagagcgagugcgcgugcgucaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaaguccaucagcagccggaacggcuucgagaugaucugggaccccaacggguggaccggcacggacaacaacuucuccaucaagcaggacaucgucgggaucaacgaguggagcggcuacuccgggucguucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 21546 - RNA, 1410 nt, Artificial Sequence
  derived and/or modified CDS sequence (AUadapt) from InfluenzaA__ADK87314__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgaggggaacaucaccgagaucguguaccucaccaacaccacgaucgagaaggagaugugccccaagcuggccgaguaccgcaacuggucgaagccgcagugcgacaucaccggcuucgcgcccuucuccaaggacaacagcauccggcuguccgccgggggcgacaucugggucacccgcgagcccuacgugucgugcgaccccgacaagugcuaccaguucgcccucgggcagggcaccacgcugaacaacgugcacuccaacaacaccguccgggaccgcaccccguaccggacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccgccugguggacuccguggucucgugguccaaggagauccugcggacccaggagagcgagugcgugugcaucaacgggacgugcaccguggucaugaccgacggcuccgccucgggcaaggccgacaccaagauccucuucaucgaggaggggaagaucgugcacacgagcaccuccucgggcuccgcgcagcacguggaggagugcagcugcuacccccgcuaccccgggguccggugcgugugccgcgacaacuggaagggcuccaaccggccgaucguggacaucaacaucaaggaccacucgaucgucuccagcuacgugugcuccggccuggugggggacacgccccgcaagaacgacucguccagcuccucgcacugccuggaccccaacaacgaggagggcgggcacggcgucaaggggugggccuucgacgacggcaacgacguguggaugggccggaccaucuccgagaagucccgccucggguacgagaccuucaaggucaucgagggcuggagcaaccccaagucgaagcugcagaucaaccgccaggugaucguggaccgggggaaccgguccggcuacagcgggaucuucucggucgagggcaaguccugcaucaaccgcugcuucuacguggagcugauccggggccgcaaggaggagaccgaggugcucuggaccagcaacuccaucgucguguucugcgggaccagcggcacguacgggaccggcuccuggccggacggggccgacaucaaccugaugcccguguga

SEQ ID NO: 21547 - RNA, 1410 nt, Artificial Sequence
  derived and/or modified CDS sequence (AUadapt) from InfluenzaA__ADK87316__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagaucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21548 - RNA, 1410 nt, Artificial Sequence
  derived and/or modified CDS sequence (AUadapt) from InfluenzaA__ADK87318__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacucgauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcucgugggucgagcucauccggggccgccccaaggagaacaccaucuggaccuccgggagcuccaccagcuucugcggcgugaacuccgacacggucggguggagcuggcccgacggcgccgagcugccguucaccaucgacaaguga

SEQ ID NO: 21549 - RNA, 1410 nt, Artificial Sequence
  derived and/or modified CDS sequence (AUadapt) from InfluenzaA__ADK87320__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugcaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21550 - RNA, 1410 nt, Artificial Sequence
  derived and/or modified CDS sequence (AUadapt) from InfluenzaA__ADK87324__NA
augaaccccaaccagaagaucaucaccaucggcucggugucccugaccaucucgacgaucugcuuccucaugcagaucgccauccugaucaccaccgucacccugcacuucaagcaguacgaguucaacuccccgcccaacaaccaggugaugcucugcgagcccacgaucaucgagcgcaacaucaccgagaucguguaccugaccaacaccacgaucgagaaggagaucugccccaagcuggccgaguaccggaacuggagcaagccgcagugcgacaucaccggguucgcgcccuucuccaaggacaacucgauccgccucuccgccggcggggacaucugggucacccgggagcccuacgugagcugcgaccccggcaagugcuaccaguucgcccuggggcagggcaccacgcugaacaacgugcacuccaacaacaccguccgcgaccggaccccguaccgcacccuccugaugaacgagcugggcgugcccuuccaccucgggacgaagcaggucugcaucgccuggucguccagcuccugccacgacggcaaggccuggcugcacgugugcaucaccggggacgacgagaacgcgaccgccucguucaucuacaacggccggcugguggacuccguggucagcugguccaaggagauccuccgcacccaggagucggagugcgugugcaucaacgggacgugcaccguggucaugaccgacggcuccgccagcggcaaggccgacaccaagauccuguucaucgaggaggggaagaucgugcacacgucgacccuguccggcagcgcgcagcacguggaggagugcuccugcuacccccgguaccccgggguccgcugcgugugccgggacaacuggaagggcucgaaccgcccgaucguggacaucaacaucaaggaccacuccaucgucagcuccuacgugugcucgggccucgugggggacacgccccggaagaacgacuccagcuccucgucccacugccuggaccccaacaacgaggagggcgggcacggcgucaaggggugggccuucgacgacggcaacgacguguggaugggccgcaccaucagcgagaagucccggcugggguacgagaccuucaaggucaucgagggcuggucgaaccccaaguccaagcuccagaucaaccgccaggugaucguggaccgggggaaccgcagcggcuacuccgggaucuucucggucgagggcaagagcugcaucaaccggugcuucuacguggagcugauccgcggccggaaggaggagaccgaggugcuguggaccuccaacucgaucgucguguucugcgggaccuccggcacguacgggaccggcagcuggccggacggggccgacaucaaccucaugcccguguga

SEQ ID NO: 21551 - RNA, 1410 nt, Artificial Sequence
  derived and/or modified CDS sequence (AUadapt) from InfluenzaA__ADK87327__NA
augaaccccaaccagaagaucaugaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagcggucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccguguga

SEQ ID NO: 21552 - RNA, 1410 nt, Artificial Sequence; identical to SEQ ID NO: 16318
  derived and/or modified CDS sequence (AUadapt) from InfluenzaA__ADK87329__NA

SEQ ID NO: 21553 - RNA, 1410 nt, Artificial Sequence
  derived and/or modified CDS sequence (AUadapt) from InfluenzaA__ADK87330__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucugggccagcggguccagcaucuccuucugcggcgugaacagcgacaccgucgggugguccuggcccgacggcgcggagcugccguucaccaucgacaaguga

SEQ ID NO: 21554 - RNA, 1410 nt, Artificial Sequence; identical to SEQ ID NO: 16318
  derived and/or modified CDS sequence (AUadapt) from InfluenzaA__ADK87331__NA

SEQ ID NO: 21555 - RNA, 1410 nt, Artificial Sequence
  derived and/or modified CDS sequence (AUadapt) from InfluenzaA__ADK87332__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaagcacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21556 - RNA, 1410 nt, Artificial Sequence
  derived and/or modified CDS sequence (AUadapt) from InfluenzaA__ADK87333__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccuacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21557 - RNA, 1410 nt, Artificial Sequence
  derived and/or modified CDS sequence (AUadapt) from InfluenzaA__ADK87335__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgaccgccgguaccaguucgcccucggccaggggaccacgcugaacaacgugcacuccgacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggaacgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggucgaaccccaagagcaagcugcagaucaaccgccaggugaucguggaccggggcaaccgcuccggguacucgggcaucuucuccgucgagggcaagagcugcaucaaccggugcuucuacguggagcucauccgcgggcgcaaggaggagaccgaggugcuguggaccucgaacuccaucgucguguucugcggcaccagcgggacguacggcaccggguccuggccggacggcgccgacaucaaccugaugcccaucuga

SEQ ID NO: 21558 - RNA, 1410 nt, Artificial Sequence
  derived and/or modified CDS sequence (AUadapt) from InfluenzaA__ADK87337__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacgccguccgcgaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggaacgcccagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccagccacugccucgaccccaacaacgaggagggcggccacggggucaagggcugggccuucgacgacgggaacgacguguggaugggccgcaccaucuccgagaagucccggcugggcuacgagaccuucaaggucaucgagggguggucgaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcaccagcgggaccuacggcacgggguccuggccggacggcgccgacaucaaccugaugcccaucuga

SEQ ID NO: 21559 - RNA, 1410 nt, Artificial Sequence
  derived and/or modified CDS sequence (AUadapt) from InfluenzaA__ADK87339__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21560 - RNA, 1410 nt, Artificial Sequence; identical to SEQ ID NO: 16318
  derived and/or modified CDS sequence (AUadapt) from InfluenzaA__ADK90209__NA

SEQ ID NO: 21561 - RNA, 1410 nt, Artificial Sequence; identical to SEQ ID NO: 16318
  derived and/or modified CDS sequence (AUadapt) from InfluenzaA__ADK90213__NA

SEQ ID NO: 21562 - RNA, 1410 nt, Artificial Sequence; identical to SEQ ID NO: 16318
  derived and/or modified CDS sequence (AUadapt) from InfluenzaA__ADK90217__NA

SEQ ID NO: 21563 - RNA, 1410 nt, Artificial Sequence; identical to SEQ ID NO: 21119
  derived and/or modified CDS sequence (AUadapt) from InfluenzaA__ADK90221__NA

SEQ ID NO: 21564 - RNA, 1410 nt, Artificial Sequence; identical to SEQ ID NO: 21119
  derived and/or modified CDS sequence (AUadapt) from InfluenzaA__ADK90225__NA

SEQ ID NO: 21565 - RNA, 1410 nt, Artificial Sequence; identical to SEQ ID NO: 16318
  derived and/or modified CDS sequence (AUadapt) from InfluenzaA__ADK90229__NA

SEQ ID NO: 21566 - RNA, 1410 nt, Artificial Sequence; identical to SEQ ID NO: 16318
  derived and/or modified CDS sequence (AUadapt) from InfluenzaA__ADK90233__NA

SEQ ID NO: 21567 - RNA, 1410 nt, Artificial Sequence
  derived and/or modified CDS sequence (AUadapt) from InfluenzaA__ADK90241__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacgccaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcacguucuuccugacccagggcgcccuccugaacgacaagcacuccaacgggaccaucaaggaccggagcccccaccgcacccugauguccugcccgaucggcgagguccccucccccuacaacagccgguucgagagcguggcgugguccgccucggccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 21568 - RNA, 1410 nt, Artificial Sequence; identical to SEQ ID NO: 21119
  derived and/or modified CDS sequence (AUadapt) from InfluenzaA__ADK90245__NA

SEQ ID NO: 21569 - RNA, 1410 nt, Artificial Sequence
  derived and/or modified CDS sequence (AUadapt) from InfluenzaA__ADK90249__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaugaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21570 - RNA, 1410 nt, Artificial Sequence; identical to SEQ ID NO: 21569
  derived and/or modified CDS sequence (AUadapt) from InfluenzaA__ADK90253__NA

SEQ ID NO: 21571 - RNA, 1410 nt, Artificial Sequence
  derived and/or modified CDS sequence (AUadapt) from InfluenzaA__ADK90257__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucgccccaccgcacccugauguccugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 21572 - RNA, 1410 nt, Artificial Sequence; identical to SEQ ID NO: 19494
  derived and/or modified CDS sequence (AUadapt) from InfluenzaA__ADK90261__NA

SEQ ID NO: 21573 - RNA, 1410 nt, Artificial Sequence
  derived and/or modified CDS sequence (AUadapt) from InfluenzaA__ADK90265__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaugggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21574 - RNA, 1410 nt, Artificial Sequence
  derived and/or modified CDS sequence (AUadapt) from InfluenzaA__ADK90269__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagaagugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacggugaugaccgacggcccguccgacggccaggccagcuacaagaucuuccgcaucgagaaggggaagaucgucaaguccaucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugaccggccuggacugcauccgccccugcuucuggguggagcucauccggggccgccccaaggagaacacgaucuggaccagcggguccaucaucagcuucugcggcgucaacuccgacaccgugggguggagcuggcccgacggcgccgagcugccguucaccaucgacaaguga

SEQ ID NO: 21575 - RNA, 1410 nt, Artificial Sequence; identical to SEQ ID NO: 16318
  derived and/or modified CDS sequence (AUadapt) from InfluenzaA__ADK90273__NA

SEQ ID NO: 21576 - RNA, 1410 nt, Artificial Sequence; identical to SEQ ID NO: 16318
  derived and/or modified CDS sequence (AUadapt) from InfluenzaA__ADK90277__NA

SEQ ID NO: 21577 - RNA, 1410 nt, Artificial Sequence; identical to SEQ ID NO: 16318
  derived and/or modified CDS sequence (AUadapt) from InfluenzaA__ADK90281__NA

SEQ ID NO: 21578 - RNA, 1410 nt, Artificial Sequence
  derived and/or modified CDS sequence (AUadapt) from InfluenzaA__ADK90289__NA
augaaccccaaccagaagaucaucaccaucggcucggugugcaugaccaucgggauggccaaccugauccuccagaucggcaacaucaucuccaucuggaucagccacuccauccagcuggggaaccagaaccugaucgagacgugcaaccagagcgucaucaccuacgagaacaacaccugggugaaccagaccuacgugaacaucuccaacacgaacuucgccgcgggccagagcgucguguccgugaagcucgccgggaacagcucccugugcccggucucgggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagucgguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21579 - RNA, 1410 nt, Artificial Sequence; identical to SEQ ID NO: 21119
  derived and/or modified CDS sequence (AUadapt) from InfluenzaA__ADK90293__NA

SEQ ID NO: 21580 - RNA, 1410 nt, Artificial Sequence; identical to SEQ ID NO: 21031
  derived and/or modified CDS sequence (AUadapt) from InfluenzaA__ADK90297__NA

SEQ ID NO: 21581 - RNA, 1410 nt, Artificial Sequence; identical to SEQ ID NO: 16318
  derived and/or modified CDS sequence (AUadapt) from InfluenzaA__ADK90301__NA

SEQ ID NO: 21582 - RNA, 1410 nt, Artificial Sequence; identical to SEQ ID NO: 21031
  derived and/or modified CDS sequence (AUadapt) from InfluenzaA__ADK90305__NA

SEQ ID NO: 21583 - RNA, 1410 nt, Artificial Sequence; identical to SEQ ID NO: 16318
  derived and/or modified CDS sequence (AUadapt) from InfluenzaA__ADK90309__NA

SEQ ID NO: 21584 - RNA, 1410 nt, Artificial Sequence
  derived and/or modified CDS sequence (AUadapt) from InfluenzaA__ADK90313__NA
augaaccccaaccacaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21585 - RNA, 1410 nt, Artificial Sequence; identical to SEQ ID NO: 16318
  derived and/or modified CDS sequence (AUadapt) from InfluenzaA__ADK90317__NA

SEQ ID NO: 21586 - RNA, 1410 nt, Artificial Sequence; identical to SEQ ID NO: 21119
  derived and/or modified CDS sequence (AUadapt) from InfluenzaA__ADK90321__NA

SEQ ID NO: 21587 - RNA, 1410 nt, Artificial Sequence; identical to SEQ ID NO: 16318
  derived and/or modified CDS sequence (AUadapt) from InfluenzaA__ADK90325__NA

SEQ ID NO: 21588 - RNA, 1410 nt, Artificial Sequence
  derived and/or modified CDS sequence (AUadapt) from InfluenzaA__ADK90329__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccgcagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacgaggccguggccguccugaaguacaacgggaucaucaccgacaccaucaagagcuggcggaacaacauccugcgcacgcaggaguccgagugcgcgugcgugaacggcucgugcuucaccgugaugaccgacgggccguccgacggccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucucguucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 21589 - RNA, 1410 nt, Artificial Sequence
  derived and/or modified CDS sequence (AUadapt) from InfluenzaA__ADK90333__NA
augaaccccaaccagaagaucaucaccaucggcucggugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21590 - RNA, 1410 nt, Artificial Sequence; identical to SEQ ID NO: 21119
  derived and/or modified CDS sequence (AUadapt) from InfluenzaA__ADK90337__NA

SEQ ID NO: 21591 - RNA, 1410 nt, Artificial Sequence; identical to SEQ ID NO: 20199
  derived and/or modified CDS sequence (AUadapt) from InfluenzaA__ADK90341__NA

SEQ ID NO: 21592 - RNA, 1410 nt, Artificial Sequence; identical to SEQ ID NO: 20199
  derived and/or modified CDS sequence (AUadapt) from InfluenzaA__ADK90345__NA

SEQ ID NO: 21593 - RNA, 1410 nt, Artificial Sequence; identical to SEQ ID NO: 20199
  derived and/or modified CDS sequence (AUadapt) from InfluenzaA__ADK90349__NA

SEQ ID NO: 21594 - RNA, 1410 nt, Artificial Sequence; identical to SEQ ID NO: 21119
  derived and/or modified CDS sequence (AUadapt) from InfluenzaA__ADK90353__NA

SEQ ID NO: 21595 - RNA, 1410 nt, Artificial Sequence; identical to SEQ ID NO: 16318
  derived and/or modified CDS sequence (AUadapt) from InfluenzaA__ADK90357__NA

SEQ ID NO: 21596 - RNA, 1410 nt, Artificial Sequence; identical to SEQ ID NO: 21119
  derived and/or modified CDS sequence (AUadapt) from InfluenzaA__ADK90361__NA

SEQ ID NO: 21597 - RNA, 1410 nt, Artificial Sequence; identical to SEQ ID NO: 20114
  derived and/or modified CDS sequence (AUadapt) from InfluenzaA__ADK90365__NA

SEQ ID NO: 21598 - RNA, 1410 nt, Artificial Sequence; identical to SEQ ID NO: 16318
  derived and/or modified CDS sequence (AUadapt) from InfluenzaA__ADK90369__NA

SEQ ID NO: 21599 - RNA, 1410 nt, Artificial Sequence; identical to SEQ ID NO: 16318
  derived and/or modified CDS sequence (AUadapt) from InfluenzaA__ADK90373__NA

SEQ ID NO: 21600 - RNA, 1410 nt, Artificial Sequence
  derived and/or modified CDS sequence (AUadapt) from InfluenzaA__ADK90377__NA
augaaccccaaccagaagaucaucaccaucggcucggugugcaugaccaucgggaugacgaaccugauccuccagaucggcaacaucaucuccaucuggaucagccacuccauccagcuggggaaccagaaccagaucgagaccugcaaccagagcgucaucaccuacgagaacaacaccugggugaaccagacguacgugaacaucuccaacaccaacuucgccgccggccagagcgucguguccgugaagcuggcggggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggacgaucaaggaccggucgccccaccgcacccugauguccugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccgacggccaggcgagcuacaagaucuuccgcaucgagaaggggaagaucgucaaguccguggagauggacgcccccaacuaccacuacgaggagugcagcugcuaccccgacuccagcgagaucaucugcgugugccgggacaacuggcacggcuccaaccgccccugggucucguucaaccagaaccucgaguaccagaucggguacaucugcuccggcaucuucggggacaacccgcggcccaacgacaagacgggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21601 - RNA, 1410 nt, Artificial Sequence; identical to SEQ ID NO: 21119
  derived and/or modified CDS sequence (AUadapt) from InfluenzaA__ADK90381__NA

SEQ ID NO: 21602 - RNA, 1410 nt, Artificial Sequence
  derived and/or modified CDS sequence (AUadapt) from InfluenzaA__ADK90385__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugucggggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagcccccaccgcacgcugauguccugcccgaucggcgagguccccagccccuacaacagccgguucgaguccguggccuggucggccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcacgugcgugaacggguccugcuucaccgugaugaccgacggcccgagcgacggccaggccuccuacaagaucuuccgcaucgagaaggggaagaucgucaagucgguggagaugaacgcgcccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 21603 - RNA, 1410 nt, Artificial Sequence; identical to SEQ ID NO: 16318
  derived and/or modified CDS sequence (AUadapt) from InfluenzaA__ADK90389__NA

SEQ ID NO: 21604 - RNA, 1410 nt, Artificial Sequence; identical to SEQ ID NO: 21119
  derived and/or modified CDS sequence (AUadapt) from InfluenzaA__ADK90393__NA

SEQ ID NO: 21605 - RNA, 1410 nt, Artificial Sequence; identical to SEQ ID NO: 21031
  derived and/or modified CDS sequence (AUadapt) from InfluenzaA__ADK90397__NA

SEQ ID NO: 21606 - RNA, 1410 nt, Artificial Sequence; identical to SEQ ID NO: 16318
  derived and/or modified CDS sequence (AUadapt) from InfluenzaA__ADK90401__NA

SEQ ID NO: 21607 - RNA, 1410 nt, Artificial Sequence
  derived and/or modified CDS sequence (AUadapt) from InfluenzaA__ADK90405__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcacgugcgugaacgggagcugcuucaccgugaugaccgacggcccguccgacggccaggcgagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21608 - RNA, 1410 nt, Artificial Sequence; identical to SEQ ID NO: 16318
  derived and/or modified CDS sequence (AUadapt) from InfluenzaA__ADK90409__NA

SEQ ID NO: 21609 - RNA, 1410 nt, Artificial Sequence
  derived and/or modified CDS sequence (AUadapt) from InfluenzaA__ADK90413__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggagcccccaccgcacgcugauguccugcccgaucggcgagguccccucccccuacaacagccgguucgagagcguggccugguccgcgucggccugccacgacgggaucaacuggcucaccaucggcaucuccggccccgacaacggggccauggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21610 - RNA, 1410 nt, Artificial Sequence; identical to SEQ ID NO: 16318
  derived and/or modified CDS sequence (AUadapt) from InfluenzaA__ADK90417__NA

SEQ ID NO: 21611 - RNA, 1410 nt, Artificial Sequence; identical to SEQ ID NO: 16318
  derived and/or modified CDS sequence (AUadapt) from InfluenzaA__ADK90421__NA

SEQ ID NO: 21612 - RNA, 1410 nt, Artificial Sequence; identical to SEQ ID NO: 16318
  derived and/or modified CDS sequence (AUadapt) from InfluenzaA__ADK90425__NA

SEQ ID NO: 21613 - RNA, 1410 nt, Artificial Sequence; identical to SEQ ID NO: 16318
  derived and/or modified CDS sequence (AUadapt) from InfluenzaA__ADK90429__NA

SEQ ID NO: 21614 - RNA, 1410 nt, Artificial Sequence; identical to SEQ ID NO: 19001
  derived and/or modified CDS sequence (AUadapt) from InfluenzaA__ADK94194__NA

SEQ ID NO: 21615 - RNA, 1410 nt, Artificial Sequence; identical to SEQ ID NO: 19001
  derived and/or modified CDS sequence (AUadapt) from InfluenzaA__ADK94205__NA

SEQ ID NO: 21616 - RNA, 1410 nt, Artificial Sequence; identical to SEQ ID NO: 20307
  derived and/or modified CDS sequence (AUadapt) from InfluenzaA__ADK94216__NA

SEQ ID NO: 21617 - RNA, 1410 nt, Artificial Sequence; identical to SEQ ID NO: 19001
  derived and/or modified CDS sequence (AUadapt) from InfluenzaA__ADK94227__NA

SEQ ID NO: 21618 - RNA, 1410 nt, Artificial Sequence; identical to SEQ ID NO: 19001
  derived and/or modified CDS sequence (AUadapt) from InfluenzaA__ADK94238__NA

SEQ ID NO: 21619 - RNA, 1410 nt, Artificial Sequence; identical to SEQ ID NO: 21525
  derived and/or modified CDS sequence (AUadapt) from InfluenzaA__ADK94260__NA

SEQ ID NO: 21620 - RNA, 1410 nt, Artificial Sequence; identical to SEQ ID NO: 21525
  derived and/or modified CDS sequence (AUadapt) from InfluenzaA__ADK94271__NA

SEQ ID NO: 21621 - RNA, 1410 nt, Artificial Sequence; identical to SEQ ID NO: 19001
  derived and/or modified CDS sequence (AUadapt) from InfluenzaA__ADK94293__NA

SEQ ID NO: 21622 - RNA, 1410 nt, Artificial Sequence; identical to SEQ ID NO: 19001
  derived and/or modified CDS sequence (AUadapt) from InfluenzaA__ADK94304__NA

SEQ ID NO: 21623 - RNA, 1410 nt, Artificial Sequence
  derived and/or modified CDS sequence (AUadapt) from InfluenzaA__ADK94326__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacauccacuccaacaacaccgugcgcgaccggaccccguaccgcacccugcucaugaacgagcugggcguccccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 21624 - RNA, 1410 nt, Artificial Sequence; identical to SEQ ID NO: 20307
  derived and/or modified CDS sequence (AUadapt) from InfluenzaA__ADK94337__NA

SEQ ID NO: 21625 - RNA, 1410 nt, Artificial Sequence; identical to SEQ ID NO: 19001
  derived and/or modified CDS sequence (AUadapt) from InfluenzaA__ADK94444__NA

SEQ ID NO: 21626 - RNA, 1410 nt, Artificial Sequence
  derived and/or modified CDS sequence (AUadapt) from InfluenzaA__ADK94479__NA
augaaccccaaccagaagaucaucaccaucggcucggugucccugaccaucucgacgaucugcuuccucaugcagaucgccauccugaccaccaccgucacgcugcacuucaagcaguacgaguucaacuccccgcccaacaaccaggugaugcucugcgagcccaccaccaucgagcgcaacaucaccgagaucguguaccugacgaacaccaccaucgagaaggagaucugccccaagcuggccgaguaccggaacuggagcaagccgcagugcgacaucaccggguucgcgcccuucuccaaggacaacucgauccgccucuccgccggcggggacaucugggucacgcgggagcccuacgugagcugcgaccccgacaagugcuaccaguucgcccugggccaggggaccacccugaacaacgugcacuccaacaacaccguccgcgaccggacgccguaccgcacccuccugaugaacgagcugggcgugcccuuccaccucggcaccaagcaggucugcaucgccuggucguccucguccugccacgacgggaaggccuggcugcacgugugcaucaccggcgacgacaagaacgcgacggccagcuucaucuacaacgggaagcugguggacuccguggucucgugguccaaggagauccuccggacccaggagagcgagugcgugugcaucaacgggaccugcaccguggucaugacggacggguccgccucgggcaaggccgacaccaagauccuguucaucgaggagggcaagaucgugcacaccucgacccuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuaccucugcucgggccuggugggcgacacgccccgcaagaacgacuccucguccagcucccacugccuggaccccaacaacgaggagggcggccacggggugaagggcugggccuucgacgacgggaacgacgucuggaugggccggaccaucucggagaagucccgccucggcuacgagaccuucaaggugaucgagggguggagcaaccccaaguccaagcugcagaucaaccggcaggucaucguggaccgcggcaaccggucgggguacuccggcaucuucucgguggagggcaagagcugcaucaaccgcugcuucuacgucgagcugauccgggggcgcaaggaggagaccggcgugcucuggacguccaacucgaucguggucuucugcgggaccuccggcaccuacgggaccggcagcuggccggacggggccgacaucaaccugaugcccaucuga

SEQ ID NO: 21627 - RNA, 1410 nt, Artificial Sequence; identical to SEQ ID NO: 19001
  derived and/or modified CDS sequence (AUadapt) from InfluenzaA__ADK94490__NA

SEQ ID NO: 21628 - RNA, 1410 nt, Artificial Sequence; identical to SEQ ID NO: 19001
  derived and/or modified CDS sequence (AUadapt) from InfluenzaA__ADK94501__NA

SEQ ID NO: 21629 - RNA, 1410 nt, Artificial Sequence
  derived and/or modified CDS sequence (AUadapt) from InfluenzaA__ADK94512__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggccggaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 21630 - RNA, 1410 nt, Artificial Sequence; identical to SEQ ID NO: 19001
  derived and/or modified CDS sequence (AUadapt) from InfluenzaA__ADK94534__NA

SEQ ID NO: 21631 - RNA, 1410 nt, Artificial Sequence; identical to SEQ ID NO: 21525
  derived and/or modified CDS sequence (AUadapt) from InfluenzaA__ADK94556__NA

SEQ ID NO: 21632 - RNA, 1410 nt, Artificial Sequence; identical to SEQ ID NO: 19001
  derived and/or modified CDS sequence (AUadapt) from InfluenzaA__ADK94567__NA

SEQ ID NO: 21633 - RNA, 1410 nt, Artificial Sequence; identical to SEQ ID NO: 19001
  derived and/or modified CDS sequence (AUadapt) from InfluenzaA__ADK94578__NA

SEQ ID NO: 21634 - RNA, 1410 nt, Artificial Sequence; identical to SEQ ID NO: 19001
  derived and/or modified CDS sequence (AUadapt) from InfluenzaA__ADK94589__NA

SEQ ID NO: 21635 - RNA, 1410 nt, Artificial Sequence; identical to SEQ ID NO: 20691
  derived and/or modified CDS sequence (AUadapt) from InfluenzaA__ADK98504__NA

SEQ ID NO: 21636 - RNA, 1410 nt, Artificial Sequence
  derived and/or modified CDS sequence (AUadapt) from InfluenzaA__ADK98506__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagaacgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21637 - RNA, 1410 nt, Artificial Sequence
  derived and/or modified CDS sequence (AUadapt) from InfluenzaA__ADK98626__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaugaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuaccugugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 21638 - RNA, 1410 nt, Artificial Sequence; identical to SEQ ID NO: 20307
  derived and/or modified CDS sequence (AUadapt) from InfluenzaA__ADK98637__NA

SEQ ID NO: 21639 - RNA, 1410 nt, Artificial Sequence
  derived and/or modified CDS sequence (AUadapt) from InfluenzaA__ADK98648__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcgcggggugaagggcugggccuucgacgacgggaacgacgucuggaugggccggaccaucucggagaagucccgccugggcuacgagaccuucaaggugaucgagggguggagcaaccccaaguccaagcugcagaucaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcaccuccgggacguacggcaccgggagcuggccggacggcgccaacaucaaccugaugcccaucuga

SEQ ID NO: 21640 - RNA, 1410 nt, Artificial Sequence
  derived and/or modified CDS sequence (AUadapt) from InfluenzaA__ADK98659__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcgggcacugccucgaccccaacaacgaggagggcgggcacggcgucaaggggugggccuucgacgacggcaacgacguguggaugggccgcaccaucuccgagaagucccggcugggguacgagaccuucaaggucaucgagggcuggucgaaccacaagagcaagcugcagaucaaccgccaggugaucguggaccgggggaaccgcuccggcuacucggggaucuucuccgucgagggcaagagcugcaucaaccggugcuucuacguggagcucauccgcggccggaaggaggagaccgaggugcuguggaccucgaacuccaucgucguguucugcgggaccagcggcacguacgggaccggcuccuggcccgacggggccgaccugaaccucaugccgaucuga

SEQ ID NO: 21641 - RNA, 1410 nt, Artificial Sequence; identical to SEQ ID NO: 21525
  derived and/or modified CDS sequence (AUadapt) from InfluenzaA__ADK98670__NA

SEQ ID NO: 21642 - RNA, 1410 nt, Artificial Sequence
  derived and/or modified CDS sequence (AUadapt) from InfluenzaA__ADK98681__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcgaggccgacaccaagauccucuucaucgaggagggcaagaucgugcacacgucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaccaaccgccaggugaucguggaccggggcaaccgcucgggguacuccggcaucuucagcgucgaggggaagaacugcaucaaccggugcuucuacguggagcucauccgcggccggaaggaggagaccgaggugcuguggaccucgaacuccaucgucguguucugcggcacgagcgggaccuacggcaccggguccuggccggacggcgccgacaucaaccugaugcccaucuga

SEQ ID NO: 21643 - RNA, 1410 nt, Artificial Sequence
  derived and/or modified CDS sequence (AUadapt) from InfluenzaA__ADK98703__NA
augaaccccaaccagaagaucaucaccaucggcucggugucccugaccaucucgacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccucguccugccacgacgggaaggccuggcuccacgugugcaucaccggcgacgacaagaacgcgaccgccagcuucaucuacaacgggcggcugguggacuccguggucucgugguccaaggagauccugcgcacgcaggagagcgagugcgugugcaucaacgggaccugcaccguggucaugaccgacggguccgccucgggcgaggccgacacgaagauccucuucaucgaggagggcaagaucgugcacaccagcacccuguccgggucggcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaccaaccgccaggugaucguggaccggggcaaccgcucgggguacuccggcaucuucagcgucgaggggaagaacugcaucaaccggugcuucuacguggagcucauccgcggccggaaggaggagaccgaggugcuguggacgucgaacuccaucgucguguucugcggcaccagcgggaccuacggcaccggguccuggccggacggcgccgacaucaaccugaugcccaucuga

SEQ ID NO: 21644 - RNA, 1410 nt, Artificial Sequence; identical to SEQ ID NO: 20886
  derived and/or modified CDS sequence (AUadapt) from InfluenzaA__ADK98725__NA

SEQ ID NO: 21645 - RNA, 1410 nt, Artificial Sequence; identical to SEQ ID NO: 21525
  derived and/or modified CDS sequence (AUadapt) from InfluenzaA__ADK98736__NA

SEQ ID NO: 21646 - RNA, 1410 nt, Artificial Sequence
  derived and/or modified CDS sequence (AUadapt) from InfluenzaA__ADK98747__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaugaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 21647 - RNA, 1410 nt, Artificial Sequence
  derived and/or modified CDS sequence (AUadapt) from InfluenzaA__ADK98758__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccaacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 21648 - RNA, 1410 nt, Artificial Sequence; identical to SEQ ID NO: 20886
  derived and/or modified CDS sequence (AUadapt) from InfluenzaA__ADK98769__NA

SEQ ID NO: 21649 - RNA, 1410 nt, Artificial Sequence; identical to SEQ ID NO: 21440
  derived and/or modified CDS sequence (AUadapt) from InfluenzaA__ADK98780__NA

SEQ ID NO: 21650 - RNA, 1410 nt, Artificial Sequence; identical to SEQ ID NO: 20886
  derived and/or modified CDS sequence (AUadapt) from InfluenzaA__ADK98791__NA

SEQ ID NO: 21651 - RNA, 1410 nt, Artificial Sequence; identical to SEQ ID NO: 19001
  derived and/or modified CDS sequence (AUadapt) from InfluenzaA__ADK98802__NA

SEQ ID NO: 21652 - RNA, 1410 nt, Artificial Sequence
  derived and/or modified CDS sequence (AUadapt) from InfluenzaA__ADK98813__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccgccaucaucgagcgcaacaucacggagaucguguaccucaccaacaccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 21653 - RNA, 1410 nt, Artificial Sequence; identical to SEQ ID NO: 19001
  derived and/or modified CDS sequence (AUadapt) from InfluenzaA__ADK98824__NA

SEQ ID NO: 21654 - RNA, 1410 nt, Artificial Sequence; identical to SEQ ID NO: 20886
  derived and/or modified CDS sequence (AUadapt) from InfluenzaA__ADK98835__NA

SEQ ID NO: 21655 - RNA, 1410 nt, Artificial Sequence; identical to SEQ ID NO: 21525
  derived and/or modified CDS sequence (AUadapt) from InfluenzaA__ADK98846__NA

SEQ ID NO: 21656 - RNA, 1410 nt, Artificial Sequence
  derived and/or modified CDS sequence (AUadapt) from InfluenzaA__ADK98857__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccacaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggcccgacggcgccaacaucaaccugaugccgaucuga

SEQ ID NO: 21657 - RNA, 1410 nt, Artificial Sequence
  derived and/or modified CDS sequence (AUadapt) from InfluenzaA__ADK98868__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaacgaggugcuguggaccuccaacagcaucgucguguucugcggcaccuccgggaccuacggcacggggagcuggccggacggcgccgacaucaaccugaugcccaucuga

SEQ ID NO: 21658 - RNA, 1410 nt, Artificial Sequence
  derived and/or modified CDS sequence (AUadapt) from InfluenzaA__ADK98879__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggccaugcugugcgagcccacgaucaucgagcgcaacaucaccgagaucguguaccucaccaacaccacgaucgagaaggagaucugccccaagcuggcggaguaccggaacuggagcaagccgcagugcgacaucaccggguucgcccccuucuccaaggacaacucgauccgccuguccgccggcggggacaucugggugacccgggagcccuacgucagcugcgaccccgacaagugcuaccaguucgcccucggccaggggaccacgcugaacaacgugcacuccaacaacaccgugcgcgaccggaccccguaccgcacccugcucaugaacgagcugggcguccccuuccaccugggcacgaagcaggucugcaucgccuggucguccagcuccugccacgacgggaaggcguggcuccacgugugcaucaccggcgacgacaagaacgccaccgccucguucaucuacaacgggcggcugguggacuccguggugagcugguccaaggagauccugcgcacccaggagucggagugcgucugcaucaacggcacgugcaccguggugaugaccgacggguccgccagcggcaaggcggacaccaagauccucuucaucgaggagggcaagaucguccacacgucgacccuguccgggagcgcccagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaucaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcaccuccgggacguacggcaccgggagcuggccggacggcgccgacaucaaccugaugcccaucuga

SEQ ID NO: 21659 - RNA, 1410 nt, Artificial Sequence; identical to SEQ ID NO: 21525
  derived and/or modified CDS sequence (AUadapt) from InfluenzaA__ADK98890__NA

SEQ ID NO: 21660 - RNA, 1410 nt, Artificial Sequence; identical to SEQ ID NO: 20886
  derived and/or modified CDS sequence (AUadapt) from InfluenzaA__ADK98901__NA

SEQ ID NO: 21661 - RNA, 1410 nt, Artificial Sequence; identical to SEQ ID NO: 21440
  derived and/or modified CDS sequence (AUadapt) from InfluenzaA__ADK98912__NA

SEQ ID NO: 21662 - RNA, 1410 nt, Artificial Sequence; identical to SEQ ID NO: 21525
  derived and/or modified CDS sequence (AUadapt) from InfluenzaA__ADK98923__NA

SEQ ID NO: 21663 - RNA, 1410 nt, Artificial Sequence; identical to SEQ ID NO: 20307
  derived and/or modified CDS sequence (AUadapt) from InfluenzaA__ADK98945__NA

SEQ ID NO: 21664 - RNA, 1410 nt, Artificial Sequence
  derived and/or modified CDS sequence (AUadapt) from InfluenzaA__ADK98956__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccgucgugagcuccuacgugugcucgggccuggucggcgacacgccccggaaguccgacagcuccagcuccucgcacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggagcaaccacaagucgaagcugcagaucaaccgccaggugaucgucgaccggggcaaccgcuccggguacagcggcaucuucucgguggaggggaaguccugcaucaaccggugcuucuacguggagcucauccgcggccggaaggaggagaccgagguccuguggaccagcaacuccaucgugguguucugcggcaccagcgggacguacggcaccggguccuggcccgacggcgccgaccugaaccucaugccgaucuga

SEQ ID NO: 21665 - RNA, 1410 nt, Artificial Sequence; identical to SEQ ID NO: 20886
  derived and/or modified CDS sequence (AUadapt) from InfluenzaA__ADK98967__NA

SEQ ID NO: 21666 - RNA, 1410 nt, Artificial Sequence; identical to SEQ ID NO: 21525
  derived and/or modified CDS sequence (AUadapt) from InfluenzaA__ADK98978__NA

SEQ ID NO: 21667 - RNA, 1410 nt, Artificial Sequence; identical to SEQ ID NO: 21664
  derived and/or modified CDS sequence (AUadapt) from InfluenzaA__ADK98989__NA

SEQ ID NO: 21668 - RNA, 1410 nt, Artificial Sequence; identical to SEQ ID NO: 19001
  derived and/or modified CDS sequence (AUadapt) from InfluenzaA__ADK99000__NA

SEQ ID NO: 21669 - RNA, 1410 nt, Artificial Sequence; identical to SEQ ID NO: 21664
  derived and/or modified CDS sequence (AUadapt) from InfluenzaA__ADK99011__NA

SEQ ID NO: 21670 - RNA, 1410 nt, Artificial Sequence
  derived and/or modified CDS sequence (AUadapt) from InfluenzaA__ADK99022__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgaccccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccaacaucaaccugaugcccaucuga

SEQ ID NO: 21671 - RNA, 1410 nt, Artificial Sequence; identical to SEQ ID NO: 19001
  derived and/or modified CDS sequence (AUadapt) from InfluenzaA__ADK99033__NA

SEQ ID NO: 21672 - RNA, 1410 nt, Artificial Sequence
  derived and/or modified CDS sequence (AUadapt) from InfluenzaA__ADK99044__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaagaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacggccacuccaacaacaccgugcgcgaccggaccccguaccgcacccugcucaugaacgagcugggcguccccuuccaccuggggacgaagcaggucugcaucgccuggucguccagcuccugccacgacggcaaggccuggcuccacgugugcaucaccggggacgacaagaacgcgaccgccucguucaucuacaacggcaagcugguggacuccguggugucgugguccaaggagauccugcggacccaggagagcgagugcgucugcaucaacgggacgugcaccguggugaugaccgacggcuccgccucgggcaaggccgacaccaagauccucuucaucgaggaggggaagaucguccacacgagcacccuguccggcucggcgcagcacguggaggagugcuccugcuacccccgcuaccccggggugcggugcgucugccgcgacaacuggaagggcagcaaccggccgaucguggacaucaacaucaaggaccacuccaucgugucguccuacgucugcagcggccuggugggggacacgccccgcaagaacgacuccucguccucgucccacugccucgaccccaacaacgaggagggcgggcacggcgugaaggggugggccuucgacgacggcaacgacgucuggaugggccggaccaucagcgagaagucccgccugggguacgagaccuucaaggugaucgagggcuggucgaaccacaaguccaagcugcagaucaaccggcaggucaucguggaccgcgggaaccggagcggcuacuccgggaucuucucgguggagggcaagagcugcaucaaccgcugcuucuacgucgagcucauccggggccgcaaggaggagaccgaggugcuguggaccuccaacucgaucguggucuucugcgggaccuccggcacguacgggaccggcagcuggcccgacggggccgaccugaaccucaugccgaucuga

SEQ ID NO: 21673 - RNA, 1410 nt, Artificial Sequence
  derived and/or modified CDS sequence (AUadapt) from InfluenzaA__ADK99055__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 21674 - RNA, 1410 nt, Artificial Sequence
  derived and/or modified CDS sequence (AUadapt) from InfluenzaA__ADK99066__NA
augaaccccaaccagaagaucaucaccaucggcucggugucccugaccaucagcacgaucugcuucuucaugcagaucgccauccucaucaccaccgucacccugcacuucaagcagugcgaguucaacuccccgcccaacaaccaggugaugcugugcgagcccacgaucaucgagcgcaacaucaccgagaucguguaccucaccaacaccacgaucgagaagaagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuaccugugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccaacaucaaccucaugcccaucuga

SEQ ID NO: 21675 - RNA, 1410 nt, Artificial Sequence
  derived and/or modified CDS sequence (AUadapt) from InfluenzaA__ADK99077__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagguggugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccacaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggcccgacggcgccgaccugaaccucaugccgaucuga

SEQ ID NO: 21676 - RNA, 1410 nt, Artificial Sequence; identical to SEQ ID NO: 21440
  derived and/or modified CDS sequence (AUadapt) from InfluenzaA__ADK99088__NA

SEQ ID NO: 21677 - RNA, 1410 nt, Artificial Sequence; identical to SEQ ID NO: 20886
  derived and/or modified CDS sequence (AUadapt) from InfluenzaA__ADK99099__NA

SEQ ID NO: 21678 - RNA, 1410 nt, Artificial Sequence
  derived and/or modified CDS sequence (AUadapt) from InfluenzaA__ADK99110__NA
augaaccccaaccagaagaucaucaccaucggcucggugucccugaccaucagcacgaucugcuucuucaugcagaucgccauccucgucaccaccgugacccugcacuucaagcaguacgaguucaacccgccgcccaacaaccaggugaugcugugcgagcccacgaucaucgagcgcaacaucaccgagaucgucuaccucaccaacaccacgaucgagaaggagaucugcccgaagcuggccgaguaccggaacugguccaagccccagugcgacaucaccggguucgcgcccuucucgaaggacaacuccauccgccugagcgccggcggggacaucugggugacccgggagcccuacguguccugcgacccggacaagugcuaccaguucgcccucggccaggggaccacgcugaacaacguccacucgaacaacaccgugcgcgaccggacccccuaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcgucguguccuggucgaaggacauccugcgcacccaggaguccgagugcgugugcaucaacggcacgugcaccgucgugaugaccgacgggagcgccuccggcaaggccgacaccaagauccucuucaucgaggagggcaagaucgugcacacgucgacccugagcggguccgcgcagcacgucgaggagugcucgugcuacccccgguacccgggcgugcgcugcgugugccgggacaacuggaagggguccaaccgccccaucgucgacaucaacaucaaggaccacagcaucguguccucguacgugugcuccggccuggucggcgacacgccccggaagaacgacagcuccucguccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggucgaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgagguccuguggaccucgaacuccaucgugguguucugcggcaccagcgggacguacggcaccggguccuggcccgacggcgccaacaucaaccugaugcccaucuga

SEQ ID NO: 21679 - RNA, 1410 nt, Artificial Sequence; identical to SEQ ID NO: 21525
  derived and/or modified CDS sequence (AUadapt) from InfluenzaA__ADK99121__NA

SEQ ID NO: 21680 - RNA, 1410 nt, Artificial Sequence
  derived and/or modified CDS sequence (AUadapt) from InfluenzaA__ADK99132__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacggucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuaccugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcuccagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcuguggaccuccaacagcaucgucguguucugcggcaccuccgggacguacggcaccgggagcuggccggacggcgccgacaucaaccucaugcccaucuga

SEQ ID NO: 21681 - RNA, 1410 nt, Artificial Sequence; identical to SEQ ID NO: 21525
  derived and/or modified CDS sequence (AUadapt) from InfluenzaA__ADK99143__NA

SEQ ID NO: 21682 - RNA, 1410 nt, Artificial Sequence; identical to SEQ ID NO: 19001
  derived and/or modified CDS sequence (AUadapt) from InfluenzaA__ADK99154__NA

SEQ ID NO: 21683 - RNA, 1410 nt, Artificial Sequence
  derived and/or modified CDS sequence (AUadapt) from InfluenzaA__ADK99176__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccugaagcuggccgaguaccggaacuggucgaagccccagugcgacaucaccggguucgcgccguucuccaaggacaacagcauccgccucuccgccggcggggacaucugggugacccgggagcccuacgugucgugcgaccccgacaagugcuaccaguucgcccugggccaggggaccacgcugaacaacguccacuccaacaacaccgugcgcgaccggacccccuaccgcacccuccugaugaacgagcugggcgugccguuccaccucggcacgaagcaggucugcaucgccuggagcuccucguccugccacgacgggaaggccuggcugcacgugugcaucaccggcgacgacaagaacgcgaccgccagcuucaucuacaacgggcggcugguggacuccgucgugagcugguccaaggacauccuccgcacccaggagucggagugcgugugcaucaacggcacgugcaccgucgugaugaccgacggguccgccagcggcaaggccgacaccaagauccuguucaucgaggagggcaagaucgugcacacgucgacccuguccgggagcgcgcagcacgucgaggagugcuccugcuacccccgguaccccggcgugcgcugcgugugccgggacaacuggaaggggucgaaccgccccaucgucgacaucaacaucaaggaccacuccaucgugagcuccuacgugugcucgggccucgucggcgacaccccgcggaagaacgacuccagcuccagcucccacugccuggaccccaacaacgaggagggcgggcacggggugaagggcugggccuucgacgacgggaacgacgucuggaugggccgcaccaucucggagaagucccggcugggcuacgagacguucaaggugaucgagggguggagcaaccccaaguccaagcuccagaucaaccgccaggugaucgucgaccggggcaaccgcucgggguacuccggcaucuucagcguggagggcaagucgugcaucaaccggugcuucuacguggagcugauccgcgggcggaaggaggagaccgagguccuguggaccuccaacagcaucgugguguucugcggcaccuccgggacguacggcaccgggagcuggcccgacggcgccaacaucaaccucaugccgaucuga

SEQ ID NO: 21684 - RNA, 1410 nt, Artificial Sequence; identical to SEQ ID NO: 21675
  derived and/or modified CDS sequence (AUadapt) from InfluenzaA__ADK99187__NA

SEQ ID NO: 21685 - RNA, 1410 nt, Artificial Sequence; identical to SEQ ID NO: 20886
  derived and/or modified CDS sequence (AUadapt) from InfluenzaA__ADK99198__NA

SEQ ID NO: 21686 - RNA, 1410 nt, Artificial Sequence; identical to SEQ ID NO: 21525
  derived and/or modified CDS sequence (AUadapt) from InfluenzaA__ADK99220__NA

SEQ ID NO: 21687 - RNA, 1410 nt, Artificial Sequence
  derived and/or modified CDS sequence (AUadapt) from InfluenzaA__ADK99231__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaacugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuaccugugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 21688 - RNA, 1410 nt, Artificial Sequence
  derived and/or modified CDS sequence (AUadapt) from InfluenzaA__ADK99242__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucaucgucuucugcggcaccuccgggacguacggcaccgggagcuggccggacggcgccgacaucaaccugaugcccaucuga

SEQ ID NO: 21689 - RNA, 1410 nt, Artificial Sequence
  derived and/or modified CDS sequence (AUadapt) from InfluenzaA__ADK99253__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggccaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugacccucaugccgaucuga

SEQ ID NO: 21690 - RNA, 1410 nt, Artificial Sequence
  derived and/or modified CDS sequence (AUadapt) from InfluenzaA__ADK99264__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuaccugugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccacaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 21691 - RNA, 1410 nt, Artificial Sequence
  derived and/or modified CDS sequence (AUadapt) from InfluenzaA__ADK99275__NA
augaaccccaaccagaagaucaucaccaucggcucggugucccugaccaucagcacgaucugcuucuucaugcagaucgccguccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccggguaccggaacuggucgaagccgcagugcgacaucaccggcuucgcgcccuucuccaaggacaacagcauccgccuguccgccgggggcgacaucugggugacccgggagcccuacgugucgugcgaccccgacaagugcuaccaguucgcccucgggcagggcaccacgcugaacaacguccacuccaacgacaccgugcgcgaccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccgucgugucgugguccaaggagauccugcgcacccaggagagcgagugcgugugcaucaacgggacgugcaccgucgugaugaccgacggcuccgccucgggcaaggccgacaccaagauccucuucaucgaggaggggaagaucgugcacacgagcacccuguccggcucggcgcagcacgucgaggagugcuccugcuacccccgguaccccggggugcgcugcgugugccgggacaacuggaagggcagcaaccgcccgaucgucgacaucaacaucaaggaccacuccaucgugucguccuacgugugcagcggccuggucggggacacgccccggaagaacgacuccucguccagcucccacugccucgaccccaacaacgaggagggcgggcacggcgugaaggggugggccuucgacgacggcaacgacgucuggaugggccgcaccaucaacgagaccucgcggcugggguacgagaccuucaaggugaucgagggcugguccaaccccaagagcaagcugcagaucaaccgccaggugaucgucgaccgggggaaccgcuccggcuacucggggaucuucuccguggagggcaagagcugcaucaaccggugcuucuacguggagcucauccgcggccggaaggaggagaccgagguccuguggaccucgaacuccaucgugguguucugcgggacgagcggcaccuacgggaccggcuccuggccggacggggccgaccugaaccucaugcccaucuga

SEQ ID NO: 21692 - RNA, 1410 nt, Artificial Sequence
  derived and/or modified CDS sequence (AUadapt) from InfluenzaA__ADK99286__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugacgccccgcgagcccaccaucaucgagcggaacaucaccgagaucguguaccugaccaacacgaccaucgagaaggagaucugccccaagcucgccgaguaccgcaacugguccaagccccagugcgacaucaccggguucgcgcccuucagcaaggacaacuccauccggcugucggccggcggggacaucugggucacccgcgagccguacguguccugcgaccccgacaagugcuaccaguucgcccugggccaggggacgacccucaacaacauccacucgaacaacaccgugcgggaccgcacccccuaccggacgcugcugaugaacgagcucggcguccccuuccaccugggcaccaagcaggucugcaucgccugguccagcuccucgugccacgacgggaaggccuggcugcacgugugcaucaccggcgacgacaagaacgcgaccgccuccuucaucuacaacgggcgccucguggacagcgugguguccuggucgaaggagauccugcggacgcaggaguccgagugcgucugcaucaacgggaccugcaccguggugaugaccgacgggucggccuccggcaaggccgacacgaagauccuguucaucgaggagggcaagaucguccacaccagcacccucucgggguccgcgcagcacguggaggagugcucgugcuacccgcgcuaccccggcgugcggugcgucugccgcgacaacuggaagggguccaaccggcccaucguggacaucaacaucaaggaccacagcaucguguccucguacgucugcuccggccuggugggcgacacgccccgcaagaacgacagcuccucguccucgcacugccuggacccgaacaacgaggagggcggccacggggugaagggcugggccuucgacgacgggaacgacgucuggaugggccggaccaucuccgagaagucccgccucggcuacgagaccuucaaggugaucgagggguggagcaaccccaagucgaagcugcagaucaaccggcaggucaucguggaccgcggcaaccgguccggguacucgggcaucuucuccguggagggcaagagcugcaucaaccgcugcuucuacgucgagcugauccgggggcgcaaggaggagaccgaggugcucuggaccucgaacuccaucguggucuucugcggcacgagcgggaccuacggcaccggguccuggcccgacggcgccgacaucaaccugaugcccaucuga

SEQ ID NO: 21693 - RNA, 1410 nt, Artificial Sequence; identical to SEQ ID NO: 19994
  derived and/or modified CDS sequence (AUadapt) from InfluenzaA__ADK99297__NA

SEQ ID NO: 21694 - RNA, 1410 nt, Artificial Sequence
  derived and/or modified CDS sequence (AUadapt) from InfluenzaA__ADK99308__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcauccccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccaacaucaaccugaugcccaucuga

SEQ ID NO: 21695 - RNA, 1413 nt, Artificial Sequence; identical to SEQ ID NO: 19863
  derived and/or modified CDS sequence (AUadapt) from InfluenzaA__ADL14590__NA

SEQ ID NO: 21696 - RNA, 1410 nt, Artificial Sequence; identical to SEQ ID NO: 20886
  derived and/or modified CDS sequence (AUadapt) from InfluenzaA__ADL27992__NA

SEQ ID NO: 21697 - RNA, 1410 nt, Artificial Sequence; identical to SEQ ID NO: 21525
  derived and/or modified CDS sequence (AUadapt) from InfluenzaA__ADL28003__NA

SEQ ID NO: 21698 - RNA, 1410 nt, Artificial Sequence; identical to SEQ ID NO: 21670
  derived and/or modified CDS sequence (AUadapt) from InfluenzaA__ADL28014__NA

SEQ ID NO: 21699 - RNA, 1410 nt, Artificial Sequence
  derived and/or modified CDS sequence (AUadapt) from InfluenzaA__ADL28025__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaagaagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuaccugugcagcggccucgugggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucagcguggagggcaagucgugcaucaaccggugcuucuacgucgagcugauccgcgggcggaaggaggagaccgaggugcuguggaccuccaacagcaucguggucuucugcggcaccuccgggacguacggcaccgggagcuggccggacggcgccgacaucaaccucaugcccaucuga

SEQ ID NO: 21700 - RNA, 1410 nt, Artificial Sequence; identical to SEQ ID NO: 20886
  derived and/or modified CDS sequence (AUadapt) from InfluenzaA__ADL28036__NA

SEQ ID NO: 21701 - RNA, 1410 nt, Artificial Sequence; identical to SEQ ID NO: 19001
  derived and/or modified CDS sequence (AUadapt) from InfluenzaA__ADL28047__NA

SEQ ID NO: 21702 - RNA, 1410 nt, Artificial Sequence; identical to SEQ ID NO: 20307
  derived and/or modified CDS sequence (AUadapt) from InfluenzaA__ADL28058__NA

SEQ ID NO: 21703 - RNA, 1410 nt, Artificial Sequence; identical to SEQ ID NO: 21678
  derived and/or modified CDS sequence (AUadapt) from InfluenzaA__ADL28069__NA

SEQ ID NO: 21704 - RNA, 1410 nt, Artificial Sequence; identical to SEQ ID NO: 21525
  derived and/or modified CDS sequence (AUadapt) from InfluenzaA__ADL28080__NA

SEQ ID NO: 21705 - RNA, 1410 nt, Artificial Sequence; identical to SEQ ID NO: 20886
  derived and/or modified CDS sequence (AUadapt) from InfluenzaA__ADL28091__NA

SEQ ID NO: 21706 - RNA, 1410 nt, Artificial Sequence
  derived and/or modified CDS sequence (AUadapt) from InfluenzaA__ADL28102__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggacauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 21707 - RNA, 1410 nt, Artificial Sequence; identical to SEQ ID NO: 19001
  derived and/or modified CDS sequence (AUadapt) from InfluenzaA__ADL28113__NA

SEQ ID NO: 21708 - RNA, 1410 nt, Artificial Sequence
  derived and/or modified CDS sequence (AUadapt) from InfluenzaA__ADL28129__NA
augaaccccaaccagaagaucaucaccaucggcucggugucccugaccaucagcacgaucugcuucuucaugcagaucgccauccucgucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggacauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagauccuguggaccuccaacagcaucgucguguucugcggcaccuccgggacguacggcaccgggagcuggccggacggcgccaacaucaaccugaugcccaucuga

SEQ ID NO: 21709 - RNA, 1410 nt, Artificial Sequence
  derived and/or modified CDS sequence (AUadapt) from InfluenzaA__ADL28140__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggaagcugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccaacaucaaccugaugcccaucuga

SEQ ID NO: 21710 - RNA, 1410 nt, Artificial Sequence; identical to SEQ ID NO: 20886
  derived and/or modified CDS sequence (AUadapt) from InfluenzaA__ADL28151__NA

SEQ ID NO: 21711 - RNA, 1410 nt, Artificial Sequence; identical to SEQ ID NO: 20307
  derived and/or modified CDS sequence (AUadapt) from InfluenzaA__ADL28162__NA

SEQ ID NO: 21712 - RNA, 1410 nt, Artificial Sequence; identical to SEQ ID NO: 21525
  derived and/or modified CDS sequence (AUadapt) from InfluenzaA__ADL28173__NA

SEQ ID NO: 21713 - RNA, 1410 nt, Artificial Sequence; identical to SEQ ID NO: 20886
  derived and/or modified CDS sequence (AUadapt) from InfluenzaA__ADL28184__NA

SEQ ID NO: 21714 - RNA, 1410 nt, Artificial Sequence
  derived and/or modified CDS sequence (AUadapt) from InfluenzaA__ADL28195__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcgugaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 21715 - RNA, 1410 nt, Artificial Sequence; identical to SEQ ID NO: 21675
  derived and/or modified CDS sequence (AUadapt) from InfluenzaA__ADL28206__NA

SEQ ID NO: 21716 - RNA, 1410 nt, Artificial Sequence; identical to SEQ ID NO: 19994
  derived and/or modified CDS sequence (AUadapt) from InfluenzaA__ADL28217__NA

SEQ ID NO: 21717 - RNA, 1410 nt, Artificial Sequence; identical to SEQ ID NO: 20886
  derived and/or modified CDS sequence (AUadapt) from InfluenzaA__ADL28228__NA

SEQ ID NO: 21718 - RNA, 1410 nt, Artificial Sequence; identical to SEQ ID NO: 21525
  derived and/or modified CDS sequence (AUadapt) from InfluenzaA__ADL28239__NA

SEQ ID NO: 21719 - RNA, 1410 nt, Artificial Sequence; identical to SEQ ID NO: 20307
  derived and/or modified CDS sequence (AUadapt) from InfluenzaA__ADL28250__NA

SEQ ID NO: 21720 - RNA, 1410 nt, Artificial Sequence; identical to SEQ ID NO: 21525
  derived and/or modified CDS sequence (AUadapt) from InfluenzaA__ADL28261__NA

SEQ ID NO: 21721 - RNA, 1410 nt, Artificial Sequence; identical to SEQ ID NO: 20886
  derived and/or modified CDS sequence (AUadapt) from InfluenzaA__ADL28373__NA

SEQ ID NO: 21722 - RNA, 1410 nt, Artificial Sequence; identical to SEQ ID NO: 19005
  derived and/or modified CDS sequence (AUadapt) from InfluenzaA__ADL28387__NA

SEQ ID NO: 21723 - RNA, 1410 nt, Artificial Sequence
  derived and/or modified CDS sequence (AUadapt) from InfluenzaA__ADL28391__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggugcccuacguguccugcgaccccgacaagugcuaccaguucgcccucggccaggggaccacgcugaacaacguccacucgaacaacaccgugcgcgaccggacccccuaccgcacccugcucaugaacgagcugggcgugccguuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcaucgucuccuggagcaaggagauccugcgcacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgguaccccggcguccgcugcgugugccgggacaacuggaagggguccaaccgccccaucguggacaucaacaucaaggaccacagcaucgucuccucguacgugugcuccggccuggugggcgacaccccgcggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagacguucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 21724 - RNA, 1410 nt, Artificial Sequence
  derived and/or modified CDS sequence (AUadapt) from InfluenzaA__ADL28395__NA
augaaccccaaccagaagaucaucaccaucggcucggugucccugaccaucgccacgaucugcuuccucaugcagaucgccauccuggucaccaccgugacccugcacuucaagcaguacgagugcaacagcccgcccaacaaccaggugaugcucugcgagcccgcgaucaucgagcgcaacaucacggagaucgucuaccugaccaacaccaccaucgagaaggagaucugccccaagcuggccgaguaccggaacugguccaagccgcagugcaacaucacgggguucgcccccuucucgaaggacaacuccauccgccucagcgccggcggggacaucugggugacccgggugcccuacgucuccugcgaccccgacaagugcuaccaguucgcccugggccaggggaccacccugaacaacggccacucgaacgacacggugcacgaccgcaccccguaccggacccuccugaugaacgagcugggcgugcccuuccaccucgggacccgccaggucugcaucgcgugguccagcuccucgugccacgacggcaaggccuggcugcacgugugcgugacgggggacgacgagaacgccaccgccuccuucaucuacaacggccggcuggucgacagcaucggguccuggucgaagaagauccuccgcacccaggaguccgagugcgugugcaucaacgggaccugcacgguggucaugaccgacggcagcgcguccgggaaggccgacaccaagauccuguucaucgaggagggcaagaucgugaacaucucgacccugagcggguccgcccagcacguggaggagugcagcugcuacccccgguaccccggcguccgcugcgugugccgggacaacuggaagggcuccaaccgcccgaucguggacaucaacgucaaggacuacucgaucguguccagcuacgugugcuccgggcucgucggcgacacgccccggaagaacgacucguucuccagcucccacugccuggaccccaacaacgaggagggcggccacggggugaagggcugggccuucgacgacggcaacgacgucuggauggggcgcaccaucucggagaaguuccgguccggcuacgagaccuucaaggugaucgagggguggagcaagcccaacuccaagcugcagaucaaccgccaggugaucgucgagcggggcaaccgcucgggguacuccggcaucuucagcguggagggcaaguccugcaucaaccggugcuucuacguggagcucauccgcgggcggaaggaggagaccgaggucugguggacgucgaacagcaucgugguguucugcggcaccuccgggaccuacggcaccgggagcuggccggacggcgccgacaucaaccugaugcccaucuga

SEQ ID NO: 21725 - RNA, 1410 nt, Artificial Sequence; identical to SEQ ID NO: 16318
  derived and/or modified CDS sequence (AUadapt) from InfluenzaA__ADL29675__NA

SEQ ID NO: 21726 - RNA, 1410 nt, Artificial Sequence; identical to SEQ ID NO: 16318
  derived and/or modified CDS sequence (AUadapt) from InfluenzaA__ADL29685__NA

SEQ ID NO: 21727 - RNA, 1410 nt, Artificial Sequence
  derived and/or modified CDS sequence (AUadapt) from InfluenzaA__ADL29695__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaucgucgggugguccuggcccgacggcgccgagcugccguucaccaucgacaaguga

SEQ ID NO: 21728 - RNA, 1410 nt, Artificial Sequence; identical to SEQ ID NO: 16318
  derived and/or modified CDS sequence (AUadapt) from InfluenzaA__ADL29705__NA

SEQ ID NO: 21729 - RNA, 1410 nt, Artificial Sequence; identical to SEQ ID NO: 21727
  derived and/or modified CDS sequence (AUadapt) from InfluenzaA__ADL29733__NA

SEQ ID NO: 21730 - RNA, 1410 nt, Artificial Sequence; identical to SEQ ID NO: 16318
  derived and/or modified CDS sequence (AUadapt) from InfluenzaA__ADL29743__NA

SEQ ID NO: 21731 - RNA, 1410 nt, Artificial Sequence
  derived and/or modified CDS sequence (AUadapt) from InfluenzaA__ADL29753__NA
augaaccccaaccagaagaucaucaccaucggcucggugugcauggccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgcggccggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaucgucgggugguccuggcccgacggcgcggagcugccguucaccaucgacaaguga

SEQ ID NO: 21732 - RNA, 1410 nt, Artificial Sequence; identical to SEQ ID NO: 16318
  derived and/or modified CDS sequence (AUadapt) from InfluenzaA__ADL29763__NA

SEQ ID NO: 21733 - RNA, 1410 nt, Artificial Sequence; identical to SEQ ID NO: 21727
  derived and/or modified CDS sequence (AUadapt) from InfluenzaA__ADL29773__NA

SEQ ID NO: 21734 - RNA, 1410 nt, Artificial Sequence; identical to SEQ ID NO: 16318
  derived and/or modified CDS sequence (AUadapt) from InfluenzaA__ADL29783__NA

SEQ ID NO: 21735 - RNA, 1410 nt, Artificial Sequence; identical to SEQ ID NO: 21727
  derived and/or modified CDS sequence (AUadapt) from InfluenzaA__ADL29882__NA

SEQ ID NO: 21736 - RNA, 1410 nt, Artificial Sequence
  derived and/or modified CDS sequence (AUadapt) from InfluenzaA__ADL32020__NA
augaaccccaaccagaagaucaucaccaucggcucggugugcaugaccaucgggauggccaaccugauccuccagaucggcaacaucaucuccacguggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21737 - RNA, 1410 nt, Artificial Sequence; identical to SEQ ID NO: 21727
  derived and/or modified CDS sequence (AUadapt) from InfluenzaA__ADL32030__NA

SEQ ID NO: 21738 - RNA, 1410 nt, Artificial Sequence; identical to SEQ ID NO: 16318
  derived and/or modified CDS sequence (AUadapt) from InfluenzaA__ADL32040__NA

SEQ ID NO: 21739 - RNA, 1410 nt, Artificial Sequence; identical to SEQ ID NO: 16318
  derived and/or modified CDS sequence (AUadapt) from InfluenzaA__ADL32050__NA

SEQ ID NO: 21740 - RNA, 1410 nt, Artificial Sequence; identical to SEQ ID NO: 16318
  derived and/or modified CDS sequence (AUadapt) from InfluenzaA__ADL32060__NA

SEQ ID NO: 21741 - RNA, 1410 nt, Artificial Sequence; identical to SEQ ID NO: 16318
  derived and/or modified CDS sequence (AUadapt) from InfluenzaA__ADL32093__NA

SEQ ID NO: 21742 - RNA, 1410 nt, Artificial Sequence; identical to SEQ ID NO: 16318
  derived and/or modified CDS sequence (AUadapt) from InfluenzaA__ADL32117__NA

SEQ ID NO: 21743 - RNA, 1410 nt, Artificial Sequence; identical to SEQ ID NO: 16318
  derived and/or modified CDS sequence (AUadapt) from InfluenzaA__ADL32347__NA

SEQ ID NO: 21744 - RNA, 1410 nt, Artificial Sequence
  derived and/or modified CDS sequence (AUadapt) from InfluenzaA__ADL32357__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgguggacaaguga

SEQ ID NO: 21745 - RNA, 1410 nt, Artificial Sequence; identical to SEQ ID NO: 16318
  derived and/or modified CDS sequence (AUadapt) from InfluenzaA__ADL32367__NA

SEQ ID NO: 21746 - RNA, 1410 nt, Artificial Sequence; identical to SEQ ID NO: 16318
  derived and/or modified CDS sequence (AUadapt) from InfluenzaA__ADL32377__NA

SEQ ID NO: 21747 - RNA, 1410 nt, Artificial Sequence; identical to SEQ ID NO: 16318
  derived and/or modified CDS sequence (AUadapt) from InfluenzaA__ADL32387__NA

SEQ ID NO: 21748 - RNA, 1410 nt, Artificial Sequence; identical to SEQ ID NO: 16318
  derived and/or modified CDS sequence (AUadapt) from InfluenzaA__ADL32397__NA

SEQ ID NO: 21749 - RNA, 1410 nt, Artificial Sequence; identical to SEQ ID NO: 16318
  derived and/or modified CDS sequence (AUadapt) from InfluenzaA__ADL32407__NA

SEQ ID NO: 21750 - RNA, 1410 nt, Artificial Sequence; identical to SEQ ID NO: 16318
  derived and/or modified CDS sequence (AUadapt) from InfluenzaA__ADL32417__NA

SEQ ID NO: 21751 - RNA, 1410 nt, Artificial Sequence
  derived and/or modified CDS sequence (AUadapt) from InfluenzaA__ADL32427__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaagaccaucuggaccagcggguccaucaucagcuucugcggcgugaacuccgacaccgucggguggagcuggcccgacggcgccgagcugccguucacgaucgacaaguga

SEQ ID NO: 21752 - RNA, 1410 nt, Artificial Sequence; identical to SEQ ID NO: 16318
  derived and/or modified CDS sequence (AUadapt) from InfluenzaA__ADL32447__NA

SEQ ID NO: 21753 - RNA, 1410 nt, Artificial Sequence
  derived and/or modified CDS sequence (AUadapt) from InfluenzaA__ADL32457__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaagagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcguguccagcgacaccgucgggugguccuggcccgacggcgccgagcugccguucacgaucgacaaguga

SEQ ID NO: 21754 - RNA, 1410 nt, Artificial Sequence; identical to SEQ ID NO: 20317
  derived and/or modified CDS sequence (AUadapt) from InfluenzaA__ADL32487__NA

SEQ ID NO: 21755 - RNA, 1410 nt, Artificial Sequence; identical to SEQ ID NO: 16318
  derived and/or modified CDS sequence (AUadapt) from InfluenzaA__ADL32497__NA

SEQ ID NO: 21756 - RNA, 1410 nt, Artificial Sequence; identical to SEQ ID NO: 16318
  derived and/or modified CDS sequence (AUadapt) from InfluenzaA__ADL32507__NA

SEQ ID NO: 21757 - RNA, 1410 nt, Artificial Sequence; identical to SEQ ID NO: 20602
  derived and/or modified CDS sequence (AUadapt) from InfluenzaA__ADL32517__NA

SEQ ID NO: 21758 - RNA, 1410 nt, Artificial Sequence; identical to SEQ ID NO: 20317
  derived and/or modified CDS sequence (AUadapt) from InfluenzaA__ADL32527__NA

SEQ ID NO: 21759 - RNA, 1410 nt, Artificial Sequence; identical to SEQ ID NO: 16318
  derived and/or modified CDS sequence (AUadapt) from InfluenzaA__ADL32537__NA

SEQ ID NO: 21760 - RNA, 1410 nt, Artificial Sequence; identical to SEQ ID NO: 20027
  derived and/or modified CDS sequence (AUadapt) from InfluenzaA__ADL32547__NA

SEQ ID NO: 21761 - RNA, 1410 nt, Artificial Sequence; identical to SEQ ID NO: 20491
  derived and/or modified CDS sequence (AUadapt) from InfluenzaA__ADL32673__NA

SEQ ID NO: 21762 - RNA, 1410 nt, Artificial Sequence; identical to SEQ ID NO: 16318
  derived and/or modified CDS sequence (AUadapt) from InfluenzaA__ADL32683__NA

SEQ ID NO: 21763 - RNA, 1410 nt, Artificial Sequence; identical to SEQ ID NO: 16274
  derived and/or modified CDS sequence (AUadapt) from InfluenzaA__ADL32693__NA

SEQ ID NO: 21764 - RNA, 1410 nt, Artificial Sequence; identical to SEQ ID NO: 20363
  derived and/or modified CDS sequence (AUadapt) from InfluenzaA__ADL32703__NA

SEQ ID NO: 21765 - RNA, 1410 nt, Artificial Sequence; identical to SEQ ID NO: 16274
  derived and/or modified CDS sequence (AUadapt) from InfluenzaA__ADL32713__NA

SEQ ID NO: 21766 - RNA, 1410 nt, Artificial Sequence; identical to SEQ ID NO: 16318
  derived and/or modified CDS sequence (AUadapt) from InfluenzaA__ADL32723__NA

SEQ ID NO: 21767 - RNA, 1410 nt, Artificial Sequence; identical to SEQ ID NO: 20821
  derived and/or modified CDS sequence (AUadapt) from InfluenzaA__ADL32733__NA

SEQ ID NO: 21768 - RNA, 1410 nt, Artificial Sequence; identical to SEQ ID NO: 20821
  derived and/or modified CDS sequence (AUadapt) from InfluenzaA__ADL32743__NA

SEQ ID NO: 21769 - RNA, 1410 nt, Artificial Sequence
  derived and/or modified CDS sequence (AUadapt) from InfluenzaA__ADL39139__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugucggagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgagcggaccccguaccgcacccugcucaugaacgagcugggcgugcccuuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacucgguggucuccuggagcaaggagauccugcgcacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 21770 - RNA, 1413 nt, Artificial Sequence
  derived and/or modified CDS sequence (AUadapt) from InfluenzaA__ADL39150__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacggagaccaucaaguccuggaagaagcagauccugcgcacccaggagucggagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcucgaaccgccccuggguguccuucaaccagaaccuggacuaccagaucggguacaucugcagcggcgucuucggcgacaacccccggcccgaggacggggagggcuccugcaacccggugaccguggacggggcgaacggcgucaagggguucagcuacaaguacggcaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 21771 - RNA, 1410 nt, Artificial Sequence
  derived and/or modified CDS sequence (AUadapt) from InfluenzaA__ADL39172__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcgaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 21772 - RNA, 1410 nt, Artificial Sequence; identical to SEQ ID NO: 19001
  derived and/or modified CDS sequence (AUadapt) from InfluenzaA__ADL39183__NA

SEQ ID NO: 21773 - RNA, 1413 nt, Artificial Sequence; identical to SEQ ID NO: 21332
  derived and/or modified CDS sequence (AUadapt) from InfluenzaA__ADL39194__NA

SEQ ID NO: 21774 - RNA, 1410 nt, Artificial Sequence; identical to SEQ ID NO: 19001
  derived and/or modified CDS sequence (AUadapt) from InfluenzaA__ADL39205__NA

SEQ ID NO: 21775 - RNA, 1413 nt, Artificial Sequence; identical to SEQ ID NO: 19863
  derived and/or modified CDS sequence (AUadapt) from InfluenzaA__ADL39227__NA

SEQ ID NO: 21776 - RNA, 1413 nt, Artificial Sequence; identical to SEQ ID NO: 21332
  derived and/or modified CDS sequence (AUadapt) from InfluenzaA__ADL39238__NA

SEQ ID NO: 21777 - RNA, 1413 nt, Artificial Sequence; identical to SEQ ID NO: 21332
  derived and/or modified CDS sequence (AUadapt) from InfluenzaA__ADL39249__NA

SEQ ID NO: 21778 - RNA, 1413 nt, Artificial Sequence; identical to SEQ ID NO: 19863
  derived and/or modified CDS sequence (AUadapt) from InfluenzaA__ADL39260__NA

SEQ ID NO: 21779 - RNA, 1410 nt, Artificial Sequence
  derived and/or modified CDS sequence (AUadapt) from InfluenzaA__ADL39282__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugcccccgccuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaagguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 21780 - RNA, 1413 nt, Artificial Sequence; identical to SEQ ID NO: 19863
  derived and/or modified CDS sequence (AUadapt) from InfluenzaA__ADL39293__NA

SEQ ID NO: 21781 - RNA, 1410 nt, Artificial Sequence
  derived and/or modified CDS sequence (AUadapt) from InfluenzaA__ADL39304__NA
augaaccccaaccagaagaucaucaccaucggcucggugucccugaccaucagcacgaucugcuucuucaugcagaucgccauccucaucaccaccgucacccugcacuucaagcaguacgaguucaacuucccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccgcgaccggaccccguaccgcacccugcucaugaacgagcugggcgugcccuuccaccugggcacgaagcaggucugcaucgccugguccagcuccagcugccacgacgggaaggccuggcuccacgugugcaucaccggcgacgacaagaacgcgaccgccuccuucaucuacaacgggcggcugguggacucgguggucuccuggagcaaggagauccugcgcacccaggaguccgagugcgugugcaucaacggcacgugcaccguggucaugaccgacgggucggccuccggcaaggccgacaccaagauccucuucaucgaggagggcaagaucgugcacacgagcacccugagcggguccgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 21782 - RNA, 1410 nt, Artificial Sequence; identical to SEQ ID NO: 19001
  derived and/or modified CDS sequence (AUadapt) from InfluenzaA__ADL39326__NA

SEQ ID NO: 21783 - RNA, 1413 nt, Artificial Sequence; identical to SEQ ID NO: 21332
  derived and/or modified CDS sequence (AUadapt) from InfluenzaA__ADL39392__NA

SEQ ID NO: 21784 - RNA, 1410 nt, Artificial Sequence
  derived and/or modified CDS sequence (AUadapt) from InfluenzaA__ADL39403__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucucgaaggacaacuccauccgccugagcgccggcggggacaucugggucacccgggagcccuacguguccugcgacccggacaagugcuaccaguucgcccucggccaggggaccacgcugaacaacgugcacucgaacaacaccguccgcgaccggacccccuaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggucgaaccacaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcaccagcgggacguacggcaccggguccuggccggacggcgccgaccugaaccucaugcccaucuga

SEQ ID NO: 21785 - RNA, 1413 nt, Artificial Sequence; identical to SEQ ID NO: 19863
  derived and/or modified CDS sequence (AUadapt) from InfluenzaA__ADL39425__NA

SEQ ID NO: 21786 - RNA, 1413 nt, Artificial Sequence
  derived and/or modified CDS sequence (AUadapt) from InfluenzaA__ADL39447__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccugaccggcaacagcucccugugcucgaucuccggcugggccaucuacacgaaggacaacagcauccggaucggguccaagggcgacguguucgugauccgcgagccguucaucagcugcucccaccucgagugccggaccuucuuccugacccagggggcccugcucaacgacaagcacucgaacggcaccgucaaggaccgcucccccuaccgggcccugaugagcugcccccugggggaggcccccagcccguacaacuccaaguucgagucgguggcgugguccgccagcgccugccacgacggcaugggcuggcucacgaucgggaucuccggccccgacaacggggccguggcgguccugaaguacaacggcaucaucaccggcaccaucaagagcuggaagaagcagauccugcgcacccaggaguccgagugcgugugcaugaacgggucgugcuucacgaucaugaccgacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugacgguggacggcgccaacggggucaagggcuucuccuacaaguacggcaacgggguguggaucggccgcaccaagagcaaccggcugcgcaagggguucgagaugaucugggaccccaacggcuggaccaacaccgacuccgacuucucggugaagcaggacgucguggcgaucacggacuggagcggguacuccggcagcuucgugcagcaccccgagcucaccggccuggacugcauccggcccugcuucugggucgagcuggugcgcgggcucccgcgggagaacaccaccaucuggacguccggcucguccaucagcuucugcggggucaacuccgacaccgccaacuggagcuggcccgacggcgccgagcugcccuucaccaucgacaaguga

SEQ ID NO: 21787 - RNA, 1413 nt, Artificial Sequence; identical to SEQ ID NO: 19863
  derived and/or modified CDS sequence (AUadapt) from InfluenzaA__ADL39458__NA

SEQ ID NO: 21788 - RNA, 1413 nt, Artificial Sequence
  derived and/or modified CDS sequence (AUadapt) from InfluenzaA__ADL39469__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucgacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 21789 - RNA, 1413 nt, Artificial Sequence
  derived and/or modified CDS sequence (AUadapt) from InfluenzaA__ADL39480__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagauggugugggaccccaacggcuggacgaacaccgacuccgacuucucggucaagcaggacgugguggccaucaccgacuggagcggguacuccggcagcuucguccagcaccccgagcucacgggccuggacugcauccggcccugcuucuggguggagcugguccgcgggcucccgcgggagaacaccaccaucuggaccuccggcucguccaucagcuucugcggggugaacuccgacacggccaacuggagcuggcccgacggcgccgagcugcccuucaccaucgacaaguga

SEQ ID NO: 21790 - RNA, 1410 nt, Artificial Sequence
  derived and/or modified CDS sequence (AUadapt) from InfluenzaA__ADL39491__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugagcgccggcggggacaucugggucacccgggagcccuacguguccugcgaccccgacaagugcuaccaguucgcccucggccaggggaccacgcugaacaacgugcacucgaacaacaucguccgcgaccggacccccuaccgcacccugcucaugaacgagcugggcgugccguuccaccugggcaccaagcaggucugcaucgccugguccagcuccucgugccacgacgggaaggccuggcuccacgugugcaucacgggcgacgacaagaacgcgaccgccuccuucaucuacaacgggcggcugguggacagcaucguguccuggagcaaggagauccugcgcacccaggaguccgagugcgucugcaucaacgggaccugcacgguggugaugaccgacgggucggccagcggcaaggccgacaccaagauccucuucaucgaggagggcaagaucguccacaccuccacgcugagcggguccgcgcagcacguggaggagugcucgugcuacccccgguaccccggcgugcgcugcgucugccgggacaacuggaagggguccaaccgccccaucguggacaucaacaucaaggaccacagcaucguguccucguacgucugcuccggccuggugggcgacaccccgcggaagaacgacagcuccagcuccucgcacugccucgaccccaacaacgaggagggcggccacggggugaagggcugggccuucgacgacgggaacgacgucuggaugggccgcaccaucuccgagaagucccggcugggcuacgagaccuucaaggugaucgagggguggagcaaccccaagucgaagcugcagaucaaccgccaggucaucguggaccggggcaaccgcuccggguacagcggcaucuucagcguggaggggaaguccugcaucaaccggugcuucuacgucgagcucauccgcggccggaaggaggagacggaggugcuguggaccucguccagcaucguggucuucugcggcaccuccgggaccuacggcacggggagcuggcccgacggcgccgacaucaaccugaugccgaucuga

SEQ ID NO: 21791 - RNA, 1410 nt, Artificial Sequence; identical to SEQ ID NO: 16318
  derived and/or modified CDS sequence (AUadapt) from InfluenzaA__ADL41165__NA

SEQ ID NO: 21792 - RNA, 1410 nt, Artificial Sequence
  derived and/or modified CDS sequence (AUadapt) from InfluenzaA__ADL41175__NA
augaaccccaaccagaagaucaucaccaucggcucggugugcaugaccaucgggauggccaaccugauccuccagaucggcaacaucaucuccacguggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacacgaucaagagcuggcgcaacaacauccugcggacccaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucguccagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 21793 - RNA, 1413 nt, Artificial Sequence
  derived and/or modified CDS sequence (AUadapt) from InfluenzaA__ADL60255__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaacuacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccaaggacggccgcggguccugcaacccggugaccguggacggcgcgaacggggucaagggcuucagcuacaaguacgacaacggcguguggaucgggcggacgaaguccaaccgccugcggaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccgccccugcuucugggucgagcuggugcggggccucccgcgcgagaacaccaccaucuggaccucgggguccagcaucuccuucugcggcgucaacagcgacacggccaacugguccuggcccgacggggccgagcugcccuucaccaucgacaaguga

SEQ ID NO: 21794 - RNA, 1413 nt, Artificial Sequence
  derived and/or modified CDS sequence (AUadapt) from InfluenzaA__ADL60277__NA
augaaccccaaccagcgcaucaucaccaucggcucgaucuccaucgccaucgggaucaucagccugaugcuccagaucggcaacaucaucuccaucugggccucgcacuccauccagaucgggagccagaacaacaccggcaucugcaaccagcggaucaucacguacgagaacuccaccugggugaaccacaccuacgucaacaucaacaacaccaacgugguggcgggggaggacaagacgccggucacccuggccggcaacagcucccugugcucgaucuccggcugggccaucuacaccaaggacaacagcauccgcaucggguccaagggcgacguguucgugauccgggagcccuucaucucgugcucccaccucgagugccgcaccuucuuccugacgcagggggcccugcucaacgacaagcacagcaacggcaccgccaaggaccggucccccuaccgcgcgcugaugagcugcccccugggggaggccccgucccccuacaacucgaaguucgagagcgucgccugguccgccagcgcgugccacgacggcaugggcuggcucaccaucgggaucuccggccccgacaacggggccguggccgugcugaaguacaacggcaucaucaccggcacgaucaagucguggaagaagcagauccugcggacccaggaguccgagugcgucugcaugaacgggagcugcuucaccaucaugaccgacggccccuccaacaaggccgccucguacaagaucuucaagaucgagaaggggaaggugacgaaguccaucgagcucaacgcgccgaacuucuacuacgaggagugcagcugcuaccccgacaccggcaucgugaugugcgucugccgcgacaacuggcacggguccaaccggcccugggugagcuucaaccagaaccuggacuaccagaucggcuacaucugcuccggcguguucggggacaacccccgcccggaggacggcgaggggucgugcaaccccgucaccguggacggcgccaacggggugaagggcuucuccuacaaguacggcaacggggucuggaucggccggaccaagagcaaccgccugcggaagggguucgagaugaucugggaccccaacggcuggacgaacaccgacuccgacuucucggugaagcaggacguggucgccaucaccgacugguccggguacagcggcagcuucgugcagcaccccgagcucaccggccuggacugcauccgcccgugcuucuggguggagcugguccgggggcucccccgcgagaacacgaccaucuggaccuccggcucguccaucagcuucugcggggugaacuccgacaccgccaacuggagcuggcccgacggcgccgagcugcccuucacgaucgacaaguga

SEQ ID NO: 21795 - RNA, 1413 nt, Artificial Sequence
  derived and/or modified CDS sequence (AUadapt) from InfluenzaA__ADL60288__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccaaggacggcaagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 21796 - RNA, 1413 nt, Artificial Sequence
  derived and/or modified CDS sequence (AUadapt) from InfluenzaA__ADL60299__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucagcaucaacaacacgaacgugguggcggggaaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccaggaccuggacuaccagaucggcuacaucugcuccggcgucuucggggacaacccccggcccaaggacggcaaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 21797 - RNA, 1413 nt, Artificial Sequence; identical to SEQ ID NO: 19034
  derived and/or modified CDS sequence (AUadapt) from InfluenzaA__ADL60310__NA

SEQ ID NO: 21798 - RNA, 1413 nt, Artificial Sequence
  derived and/or modified CDS sequence (AUadapt) from InfluenzaA__ADL60321__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcauggucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacgacaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 21799 - RNA, 1413 nt, Artificial Sequence
  derived and/or modified CDS sequence (AUadapt) from InfluenzaA__ADL60332__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuuccacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccaaggacggccgcggguccugcaacccggugaccguggacggcgcgaacggggucaagggcuucagcuacaaguacgacaacggcguguggaucgggcggacgaaguccaaccgccugcggaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccgccccugcuucugggucgagcuggugcggggccucccgcgcgagaacaccaccaucuggaccucgggguccagcaucuccuucugcggcgucaacagcgacacggccaacugguccuggcccgacggggccgagcugcccuucaccaucgacaaguga

SEQ ID NO: 21800 - RNA, 1413 nt, Artificial Sequence; identical to SEQ ID NO: 19034
  derived and/or modified CDS sequence (AUadapt) from InfluenzaA__ADL60343__NA

SEQ ID NO: 21801 - RNA, 1413 nt, Artificial Sequence
  derived and/or modified CDS sequence (AUadapt) from InfluenzaA__ADL60354__NA
augaaccccaaccagcgcaucaucaccaucggcucgaucuccaucgccaucgggaucaucagccugaugcuccagaucggcaacaucaucuccaucugggccucgcacuccauccagaucgggagccagaacaacaccggcaucugcaaccagcggaucaucacguacgagaacuccaccugggugaaccacaccuacgucaacaucaacaacaccaacgugguggcgggggaggacaagacgagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcaccuucuuccugacgcagggggcccugcucaacgacaagcacuccaacggcaccgccaaggaccggagccccuaccgcgcgcugauguccugcccccugggggaggcccccagcccguacaacucgaaguucgaguccgucgccuggagcgccuccgcgugccacgacggcaugggcuggcucaccaucgggaucagcggccccgacaacggggccguggccgugcugaaguacaacggcaucaucaccggcacgaucaaguccuggaagaagcagauccugcggacccaggagucggagugcgucugcaugaacggguccugcuucaccaucaugaccgacggccccagcaacaaggccgccuccuacaagaucuucaagaucgagaaggggaaggugaccaagagcaucgagcucaacgcgcccaacuucuacuacgaggagugcuccugcuacccggacacgggcaucgugaugugcgucugccgcgacaacuggcacgggucgaaccggcccuggguguccuucaaccagaaccuggacuaccagaucggcuacaucugcagcggcguguucggggacaacccccgccccaaggacggcaagggguccugcaacccggucaccguggacggcgccaacggggugaagggcuucagcuacaaguacggcaacggggucuggaucggccggaccaaguccaaccgccugcggaagggguucgagaugaucugggaccccaacggcuggacgaacaccgacucggacuucuccgugaagcaggacguggucgccaucaccgacuggagcggguacagcggcuccuucgugcagcaccccgagcucaccggccuggacugcauccgccccugcuucuggguggagcugguccgggggcucccgcgcgagaacacgaccaucuggaccucgggcuccagcaucuccuucugcggggugaacagcgacaccgccaacugguccuggcccgacggcgccgagcugcccuucacgaucgacaaguga

SEQ ID NO: 21802 - RNA, 1410 nt, Artificial Sequence
  derived and/or modified CDS sequence (AUadapt) from InfluenzaA__ADL60365__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucucccccaagcuggccgaguaccggaacuggagcaagccccagugcgacaucaccggguucgcgccguucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaucguccgcgaccggacccccuaccgcacccugcucaugaacgagcugggcgugccguuccaccugggcaccaagcaggucugcaucgccuggucguccagcuccugccacgacgggaaggccuggcuccacgugugcaucacgggcgacgacaagaacgcgaccgccucguucaucuacaacgggcggcugguggacuccaucgugagcugguccaaggagauccugcgcacccaggagucggagugcgucugcaucaacgggaccugcacgguggugaugaccgacgggagcgccuccggcaaggccgacaccaagauccucuucaucgaggagggcaagaucguccacaccagcacgcuguccgggucggcgcagcacguggaggagugcuccugcuacccccgguaccccggcgugcgcugcgucugccgggacaacuggaaggggagcaaccgccccaucguggacaucaacaucaaggaccacuccaccgugucguccuacgucugcagcggccuggugggcgacaccccgcggaagaacgacuccucguccagcucccacugccucgaccccaacaacgaggagggcggccacggggugaagggcugggccuucgacgacgggaacgacgucuggaugggccgcaccaucucggagaagucccggcugggcuacgagacguucaaggugaucgagggguggagcaaccccaaguccaagcugcagaucaaccgccaggucaucguggaccggggcaaccgcucgggguacagcggcaucuucuccguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggcccgacggcgccgacaucaaccugaugccgaucuga

SEQ ID NO: 21803 - RNA, 1413 nt, Artificial Sequence
  derived and/or modified CDS sequence (AUadapt) from InfluenzaA__ADL60376__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgggaaggaccgcucgcccuaccgggcccugauguccugcccccugggcgaggcgcccagcccguacaacucgaaguucgaguccgucgccuggagcgccuccgccugccacgacggcaugggguggcucaccaucggcaucagcgggcccgacaacggcgcgguggccgugcugaaguacaacggcaucaucacggggaccaucaaguccuggaagaagcagauccugcgcacccaggagucggagugcgucugcaugaacggcuccugcuucaccaucaugacggacgggcccagcaacaaggccgccuccuacaagaucuucaagaucgagaagggcaaggugaccaagucgaucgagcucaacgcccccaacuuccacuacgaggagugcuccugcuacccggacaccgggaucgugaugugcgucugccgggacaacuggcacggcagcaaccgccccuggguguccuucaaccagaaccuggacuaccagaucggcuacaucugcucggggguguucggcgacaacccccggcccaaggacgggaagggcuccugcaacccggucaccguggacggggcgaacggcgugaagggcuucagcuacaaguacgacaacggggucuggaucggccgcacgaaguccaaccggcugcgcaagggguucgagaugaucugggaccccaacggcuggaccaacaccgacagcgacuucuccgugaagcaggacguggucgccaucaccgacuggucgggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 21804 - RNA, 1410 nt, Artificial Sequence; identical to SEQ ID NO: 16318
  derived and/or modified CDS sequence (AUadapt) from InfluenzaA__ADM07137__NA

SEQ ID NO: 21805 - RNA, 1410 nt, Artificial Sequence; identical to SEQ ID NO: 16318
  derived and/or modified CDS sequence (AUadapt) from InfluenzaA__ADM07146__NA

SEQ ID NO: 21806 - RNA, 1410 nt, Artificial Sequence; identical to SEQ ID NO: 16318
  derived and/or modified CDS sequence (AUadapt) from InfluenzaA__ADM07156__NA

SEQ ID NO: 21807 - RNA, 1410 nt, Artificial Sequence; identical to SEQ ID NO: 16318
  derived and/or modified CDS sequence (AUadapt) from InfluenzaA__ADM07165__NA

SEQ ID NO: 21808 - RNA, 1413 nt, Artificial Sequence; identical to SEQ ID NO: 19863
  derived and/or modified CDS sequence (AUadapt) from InfluenzaA__ADM07474__NA

SEQ ID NO: 21809 - RNA, 1413 nt, Artificial Sequence; identical to SEQ ID NO: 19863
  derived and/or modified CDS sequence (AUadapt) from InfluenzaA__ADM07485__NA

SEQ ID NO: 21810 - RNA, 1410 nt, Artificial Sequence
  derived and/or modified CDS sequence (AUadapt) from InfluenzaA__ADM07496__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaacaucaugcccaucuga

SEQ ID NO: 21811 - RNA, 1410 nt, Artificial Sequence
  derived and/or modified CDS sequence (AUadapt) from InfluenzaA__ADM07507__NA
augaaccccaaccagaagaucaucaccaucggcucggugucccugaccaucagcacgaucugcuucuucaugcagaccgccauccucaucaccaccgucacgcugcacuucaagcaguucgaguucaacuccccgcccaacaaccaggugaugcugugcgagcccgccaucaucgagcgcaacaucaccgagaucguguaccucaccaacaccacgaucgagaaggagaucugccccaagcuggcggaguaccggaacuggucgaagccgcagugcgacaucaccggguucgcccccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggcguggcuccacgugugcaucaccggcgacgacaagaacgccaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggcggacaccaagauccucuucaucgaggagggcaagaucgugcacacgagcacccuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 21812 - RNA, 1410 nt, Artificial Sequence
  derived and/or modified CDS sequence (AUadapt) from InfluenzaA__ADM12820__NA
augaaccccaaccagaagaucaucaccaucggcucggugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 21813 - RNA, 1410 nt, Artificial Sequence; identical to SEQ ID NO: 21812
  derived and/or modified CDS sequence (AUadapt) from InfluenzaA__ADM12831__NA

SEQ ID NO: 21814 - RNA, 1410 nt, Artificial Sequence; identical to SEQ ID NO: 21812
  derived and/or modified CDS sequence (AUadapt) from InfluenzaA__ADM12842__NA

SEQ ID NO: 21815 - RNA, 1410 nt, Artificial Sequence; identical to SEQ ID NO: 21812
  derived and/or modified CDS sequence (AUadapt) from InfluenzaA__ADM12853__NA

SEQ ID NO: 21816 - RNA, 1410 nt, Artificial Sequence; identical to SEQ ID NO: 16318
  derived and/or modified CDS sequence (AUadapt) from InfluenzaA__ADM12864__NA

SEQ ID NO: 21817 - RNA, 1410 nt, Artificial Sequence; identical to SEQ ID NO: 16318
  derived and/or modified CDS sequence (AUadapt) from InfluenzaA__ADM12874__NA

SEQ ID NO: 21818 - RNA, 1410 nt, Artificial Sequence; identical to SEQ ID NO: 16318
  derived and/or modified CDS sequence (AUadapt) from InfluenzaA__ADM12884__NA

SEQ ID NO: 21819 - RNA, 1410 nt, Artificial Sequence
  derived and/or modified CDS sequence (AUadapt) from InfluenzaA__ADM12894__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccagagcuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21820 - RNA, 1410 nt, Artificial Sequence; identical to SEQ ID NO: 16318
  derived and/or modified CDS sequence (AUadapt) from InfluenzaA__ADM12904__NA

SEQ ID NO: 21821 - RNA, 1410 nt, Artificial Sequence
  derived and/or modified CDS sequence (AUadapt) from InfluenzaA__ADM12914__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcuacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21822 - RNA, 1410 nt, Artificial Sequence; identical to SEQ ID NO: 16318
  derived and/or modified CDS sequence (AUadapt) from InfluenzaA__ADM12924__NA

SEQ ID NO: 21823 - RNA, 1410 nt, Artificial Sequence; identical to SEQ ID NO: 16318
  derived and/or modified CDS sequence (AUadapt) from InfluenzaA__ADM12934__NA

SEQ ID NO: 21824 - RNA, 1410 nt, Artificial Sequence; identical to SEQ ID NO: 16318
  derived and/or modified CDS sequence (AUadapt) from InfluenzaA__ADM12944__NA

SEQ ID NO: 21825 - RNA, 1410 nt, Artificial Sequence; identical to SEQ ID NO: 16318
  derived and/or modified CDS sequence (AUadapt) from InfluenzaA__ADM12954__NA

SEQ ID NO: 21826 - RNA, 1410 nt, Artificial Sequence; identical to SEQ ID NO: 16318
  derived and/or modified CDS sequence (AUadapt) from InfluenzaA__ADM12964__NA

SEQ ID NO: 21827 - RNA, 1410 nt, Artificial Sequence; identical to SEQ ID NO: 20428
  derived and/or modified CDS sequence (AUadapt) from InfluenzaA__ADM12974__NA

SEQ ID NO: 21828 - RNA, 1410 nt, Artificial Sequence
  derived and/or modified CDS sequence (AUadapt) from InfluenzaA__ADM12984__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccauccgcagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21829 - RNA, 1410 nt, Artificial Sequence; identical to SEQ ID NO: 16318
  derived and/or modified CDS sequence (AUadapt) from InfluenzaA__ADM12994__NA

SEQ ID NO: 21830 - RNA, 1410 nt, Artificial Sequence; identical to SEQ ID NO: 16318
  derived and/or modified CDS sequence (AUadapt) from InfluenzaA__ADM13004__NA

SEQ ID NO: 21831 - RNA, 1410 nt, Artificial Sequence; identical to SEQ ID NO: 16318
  derived and/or modified CDS sequence (AUadapt) from InfluenzaA__ADM13014__NA

SEQ ID NO: 21832 - RNA, 1410 nt, Artificial Sequence
  derived and/or modified CDS sequence (AUadapt) from InfluenzaA__ADM13034__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcaacugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21833 - RNA, 1410 nt, Artificial Sequence; identical to SEQ ID NO: 21053
  derived and/or modified CDS sequence (AUadapt) from InfluenzaA__ADM13044__NA

SEQ ID NO: 21834 - RNA, 1410 nt, Artificial Sequence; identical to SEQ ID NO: 19966
  derived and/or modified CDS sequence (AUadapt) from InfluenzaA__ADM13054__NA

SEQ ID NO: 21835 - RNA, 1410 nt, Artificial Sequence; identical to SEQ ID NO: 20317
  derived and/or modified CDS sequence (AUadapt) from InfluenzaA__ADM13064__NA

SEQ ID NO: 21836 - RNA, 1410 nt, Artificial Sequence
  derived and/or modified CDS sequence (AUadapt) from InfluenzaA__ADM13074__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21837 - RNA, 1410 nt, Artificial Sequence; identical to SEQ ID NO: 20317
  derived and/or modified CDS sequence (AUadapt) from InfluenzaA__ADM13084__NA

SEQ ID NO: 21838 - RNA, 1410 nt, Artificial Sequence
  derived and/or modified CDS sequence (AUadapt) from InfluenzaA__ADM13094__NA
augaaccccaaccagaagaucaucaccaucggcucggugugcaugaccaucgggauggccaaccugauccuccagaucggcaacacgaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagucggucguguccgccaagcuggccgggaacagcucccucugcccggugagcggcugggccaucuacuccaaggacaacagcauccgcaucggcuccaagggggacgucuucgugauccgggagcccuucaucucgugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacucgcgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagucgaucagcucccggaacggcuucgagaugaucugggaccccaacggguggaccggcacggacaacaacuucagcaucaagcaggacaucgucgggaucaacgagugguccggcuacucgggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgcggagcugccguucaccaucgacaaguga

SEQ ID NO: 21839 - RNA, 1410 nt, Artificial Sequence; identical to SEQ ID NO: 20317
  derived and/or modified CDS sequence (AUadapt) from InfluenzaA__ADM13104__NA

SEQ ID NO: 21840 - RNA, 1410 nt, Artificial Sequence; identical to SEQ ID NO: 21042
  derived and/or modified CDS sequence (AUadapt) from InfluenzaA__ADM13124__NA

SEQ ID NO: 21841 - RNA, 1410 nt, Artificial Sequence
  derived and/or modified CDS sequence (AUadapt) from InfluenzaA__ADM13134__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacacgcugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21842 - RNA, 1410 nt, Artificial Sequence
  derived and/or modified CDS sequence (AUadapt) from InfluenzaA__ADM13154__NA
augaaccccaaccagaagaucaucaccaucggcucggugugcaugaccaucgggauggccaaccugauccuccagaucggcaacaucaucuccaucuggaucagccacuccauccagcuggggaaccagaagcagaucgagacgugcaaccagagcgucuucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuucaagaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucucgucccgcaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21843 - RNA, 1410 nt, Artificial Sequence; identical to SEQ ID NO: 20570
  derived and/or modified CDS sequence (AUadapt) from InfluenzaA__ADM13164__NA

SEQ ID NO: 21844 - RNA, 1410 nt, Artificial Sequence; identical to SEQ ID NO: 16318
  derived and/or modified CDS sequence (AUadapt) from InfluenzaA__ADM13174__NA

SEQ ID NO: 21845 - RNA, 1410 nt, Artificial Sequence; identical to SEQ ID NO: 16318
  derived and/or modified CDS sequence (AUadapt) from InfluenzaA__ADM13184__NA

SEQ ID NO: 21846 - RNA, 1410 nt, Artificial Sequence; identical to SEQ ID NO: 16318
  derived and/or modified CDS sequence (AUadapt) from InfluenzaA__ADM13194__NA

SEQ ID NO: 21847 - RNA, 1410 nt, Artificial Sequence; identical to SEQ ID NO: 16318
  derived and/or modified CDS sequence (AUadapt) from InfluenzaA__ADM13204__NA

SEQ ID NO: 21848 - RNA, 1410 nt, Artificial Sequence; identical to SEQ ID NO: 20317
  derived and/or modified CDS sequence (AUadapt) from InfluenzaA__ADM13214__NA

SEQ ID NO: 21849 - RNA, 1410 nt, Artificial Sequence
  derived and/or modified CDS sequence (AUadapt) from InfluenzaA__ADM13224__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccauccgcagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcaagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21850 - RNA, 1410 nt, Artificial Sequence; identical to SEQ ID NO: 16318
  derived and/or modified CDS sequence (AUadapt) from InfluenzaA__ADM13234__NA

SEQ ID NO: 21851 - RNA, 1410 nt, Artificial Sequence; identical to SEQ ID NO: 20428
  derived and/or modified CDS sequence (AUadapt) from InfluenzaA__ADM13244__NA

SEQ ID NO: 21852 - RNA, 1410 nt, Artificial Sequence; identical to SEQ ID NO: 19494
  derived and/or modified CDS sequence (AUadapt) from InfluenzaA__ADM13254__NA

SEQ ID NO: 21853 - RNA, 1410 nt, Artificial Sequence; identical to SEQ ID NO: 20317
  derived and/or modified CDS sequence (AUadapt) from InfluenzaA__ADM13264__NA

SEQ ID NO: 21854 - RNA, 1410 nt, Artificial Sequence; identical to SEQ ID NO: 16318
  derived and/or modified CDS sequence (AUadapt) from InfluenzaA__ADM13274__NA

SEQ ID NO: 21855 - RNA, 1410 nt, Artificial Sequence; identical to SEQ ID NO: 16318
  derived and/or modified CDS sequence (AUadapt) from InfluenzaA__ADM13284__NA

SEQ ID NO: 21856 - RNA, 1410 nt, Artificial Sequence
  derived and/or modified CDS sequence (AUadapt) from InfluenzaA__ADM13294__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcgcccugaugucgugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacagcuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgcggagcugccguucaccaucgacaaguga

SEQ ID NO: 21857 - RNA, 1410 nt, Artificial Sequence; identical to SEQ ID NO: 16318
  derived and/or modified CDS sequence (AUadapt) from InfluenzaA__ADM13304__NA

SEQ ID NO: 21858 - RNA, 1410 nt, Artificial Sequence; identical to SEQ ID NO: 20602
  derived and/or modified CDS sequence (AUadapt) from InfluenzaA__ADM13314__NA

SEQ ID NO: 21859 - RNA, 1410 nt, Artificial Sequence; identical to SEQ ID NO: 16318
  derived and/or modified CDS sequence (AUadapt) from InfluenzaA__ADM13324__NA

SEQ ID NO: 21860 - RNA, 1410 nt, Artificial Sequence
  derived and/or modified CDS sequence (AUadapt) from InfluenzaA__ADM13344__NA
augaaccccaaccagaagaucaucaucaucggcucggugugcaugaccaucgggauggccaaccugauccuccagaucggcaacaucaucuccaucuggauccugcacagcauccagcuggggaaccagaaccagaucgagaccugcaaccaguccgucaucacguacgagaacaacaccugggugaaccagaccuacgugaacaucagcaacaccaacuucgccgcgggccaguccgucgugagcgugaagcucgccgggaacuccagccugugcccggucuccggcugggccaucuacucgaaggacaacuccauccgcaucggcagcaagggggacguguucgugauccgggagcccuucaucuccugcagcccccuggagugccgcacguucuuccucacccagggcgcccugcugaacgacaagcacuccaacgggaccaucaaggaccggagccccuaccgcacccucauguccugcccgaucggcgagguccccagccccuacaacucccgguucgagucgguggccuggagcgcguccgccugccacgacgggaucaacuggcugacgaucggcaucagcggccccgacaacggggccguggccguccugaaguacaacggcaucaucaccgacaccaucaaguccuggcgcaacaacauccuccggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucucgagccggaacggcuucgagaugaucugggaccccaacggguggaccggcaccgacaacaacuucgccaucaagcaggacaucguggggaucaacgagugguccggcuacagcggguccuucgugcagcacccggagcugaccggccucgacugcauccgccccugcuucugggucgagcugauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 21861 - RNA, 1410 nt, Artificial Sequence; identical to SEQ ID NO: 21042
  derived and/or modified CDS sequence (AUadapt) from InfluenzaA__ADM13354__NA

SEQ ID NO: 21862 - RNA, 1410 nt, Artificial Sequence; identical to SEQ ID NO: 20317
  derived and/or modified CDS sequence (AUadapt) from InfluenzaA__ADM13363__NA

SEQ ID NO: 21863 - RNA, 1410 nt, Artificial Sequence
  derived and/or modified CDS sequence (AUadapt) from InfluenzaA__ADM13464__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccgggaacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucauccggggccgcgagcaggagacccgggugugguggaccuccaacucgaucguggucuucugcgggaccuccggcacguacgggaccggcagcuggccggacggggccaacaucaacuucaugcccaucuga

SEQ ID NO: 21864 - RNA, 1410 nt, Artificial Sequence
  derived and/or modified CDS sequence (AUadapt) from InfluenzaA__ADM13465__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcucaugcggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 21865 - RNA, 1410 nt, Artificial Sequence; identical to SEQ ID NO: 16337
  derived and/or modified CDS sequence (AUadapt) from InfluenzaA__ADM13466__NA

SEQ ID NO: 21866 - RNA, 1410 nt, Artificial Sequence
  derived and/or modified CDS sequence (AUadapt) from InfluenzaA__ADM13467__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccagcggcggggacaucugggugacgcgggagcccuacguguccugcgaccacggcaagugcuaccaguucgcccuggggcagggcaccacccucgacaacaagcacucgaacgacaccauccacgaccgcaucccccaccggacgcugcugaugaacgagcucggcgucccguuccaccuggggacccgccaggugugcaucgccugguccagcuccucgugccacgacggcaaggccuggcugcacgugugcaucaccggggacgacaagaacgcgaccgccuccuucaucuacgacggccggcucgucgacucgaucggguccuggagccagaacauccugcgcacgcaggaguccgagugcgugugcaucaacgggaccugcaccguggucaugaccgacggcucggccagcggccgggccgacacgcgcauccuguucaucgaggagggcaagaucgugcacaucucgccccucuccggguccgcgcagcacguggaggagugcagcugcuacccccgguaccccggcguccgcugcaucugccgggacaacuggaagggcuccaaccgcccggugguggacaucaacauggaggacuacucgaucgacuccagcuacgucugcuccgggcuggugggcgacacgccccggaacgacgaccgcucguccaacucgaacugccggaaccccaacaacgagcgcgggaaccagggcgugaaggggugggccuucgacaacggcgacgacgucuggaugggccggaccaucuccaaggaccugcgcagcggguacgagaccuucaaggugaucggcgggugguccacccccaacucgaagucccagaucaaccggcaggucaucguggacagcgacaaccgcuccggcuacucggggaucuucagcguggagggcaaguccugcaucaaccgcugcuucuacgucgagcucauccggggccgcaagcaggagacccgggugugguggaccucgaacuccaucguggucuucugcgggaccagcggcacguacgggaccggcuccuggccggacggggccaacaucaacuucaugcccaucuga

SEQ ID NO: 21867 - RNA, 1410 nt, Artificial Sequence; identical to SEQ ID NO: 16337
  derived and/or modified CDS sequence (AUadapt) from InfluenzaA__ADM13468__NA

SEQ ID NO: 21868 - RNA, 1410 nt, Artificial Sequence
  derived and/or modified CDS sequence (AUadapt) from InfluenzaA__ADM13469__NA
augaaccccaaccagaagaucaucaccaucggcucggugucccugaccaucgccacggccugcuuccucaugcagaucgcgauccuggucaccaccgugacccugcacuucaagcaguacgagugcgacucgccggccuccaaccaggugaugcccugcgagcccaucaucaucgagcgcaacaucacggagaucgucuaccucaacaacaccaccaucgagaaggagaucugccccaaggugguggaguaccggaacuggagcaagccgcagugccagaucaccggguucgcccccuucuccaaggacaacucgauccgccuguccgccggcggggacaucugggucacgcgggagcccuacgugucgugcgaccacggcaagugcuaccaguucgcccuggggcagggcaccacccucgacaacaagcacuccaacgacaccauccacgaccgcaucccccaccggacgcugcugaugaacgagcucggcgugccguuccaccuggggacccgccaggucugcaucgcguggagcuccucguccugccacgacggcaaggccuggcugcacgugugcaucaccggggacgacaagaacgccaccgccucguucaucuacgacggccggcucguggacuccaucgggagcuggucccagaacauccugcgcacgcaggagucggagugcgucugcaucaacgggaccugcaccguggugaugaccgacggcuccgcgucgggccgggccgacacgcgcauccuguucaucgaggagggcaagaucguccacaucagcccccucuccgggucggcccagcacguggaggagugcuccugcuacccccgguaccccggcgugcgcugcaucugccgggacaacuggaagggcagcaaccgcccggucguggacaucaacauggaggacuacuccaucgacucguccuacgugugcucggggcuggucggcgacacgccccggaacgacgaccgcuccagcaacuccaacugccggaaccccaacaacgagcgcgggaaccagggcgugaaggggugggccuucgacaacggcgacgacguguggaugggccggaccaucucgaaggaccugcgcuccggguacgagaccuucaaggucaucggcggguggucgacccccaacuccaagagccagaucaaccgccaggugaucgucgacuccgacaaccggucgggcuacuccgggaucuucucgguggagggcaagagcugcaucaaccgcugcuucuacguggagcucauccggggccgcaagcaggagacccgggucugguggaccuccaacucgaucgugguguucugcgggaccuccggcacguacgggaccggcagcuggccggacggggccaacaucaacuucaugcccaucuga

SEQ ID NO: 21869 - RNA, 1410 nt, Artificial Sequence
  derived and/or modified CDS sequence (AUadapt) from InfluenzaA__ADM13470__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucaucgacuccgacaaccgcucgggcuacuccgggaucuucucgguggagggcaagagcugcaucaaccgcugcuucuacguggagcucauccggggccgcaagcaggagacccgggucugguggaccuccaacucgaucgugguguucugcgggaccuccggcacguacgggaccggcagcuggccggacggggccaacaucaacuucaugcccaucuga

SEQ ID NO: 21870 - RNA, 1410 nt, Artificial Sequence
  derived and/or modified CDS sequence (AUadapt) from InfluenzaA__ADM13471__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgcaucuccgccggcggggacaucugggugacgcgggagcccuacgugagcugcgaccacggcaagugcuaccaguucgcccuggggcagggcaccacccuggacaacaagcacuccaacgacaccauccacgaccgcaucccccaccggacgcuccugaugaacgagcugggcgucccguuccaccucgggacccgccaggugugcaucgccuggucguccucguccugccacgacggcaaggcguggcugcacgugugcaucaccggggacgacaagaacgccaccgccagcuucaucuacgacggccggcuggucgacuccaucgggucguggucccagaacauccuccgcacgcaggagagcgagugcgugugcaucaacgggaccugcaccguggucaugaccgacggcuccgccucgggccgggcggacacgcgcauccuguucaucgaggagggcaagaucgugcacaucucgccccuguccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcucgugggcgacacgccccggaacgacgaccgcuccucgaacuccaacugccggaaccccaacaacgagcgcgggaaccagggcgugaaggggugggccuucgacaacggcgacgacgucuggaugggccggaccaucagcaaggaccugcgcuccggguacgagaccuucaaggugaucggcggguggucgacccccaacuccaagagccagaucaaccggcaggucaucguggacuccgacaaccgcucgggcuacuccgggaucuucucgguggagggcaagagcugcaucaaccgcugcuucuacgucgagcugauccggggccgcaagcaggagacccgggugugguggaccuccaacucgaucguggucuucugcgggaccuccggcacguacgggaccggcagcuggccggacggggccaacaucaacuucaugcccaucuga

SEQ ID NO: 21871 - RNA, 1410 nt, Artificial Sequence; identical to SEQ ID NO: 18910
  derived and/or modified CDS sequence (AUadapt) from InfluenzaA__ADM13472__NA

SEQ ID NO: 21872 - RNA, 1410 nt, Artificial Sequence; identical to SEQ ID NO: 16337
  derived and/or modified CDS sequence (AUadapt) from InfluenzaA__ADM13473__NA

SEQ ID NO: 21873 - RNA, 1410 nt, Artificial Sequence; identical to SEQ ID NO: 18905
  derived and/or modified CDS sequence (AUadapt) from InfluenzaA__ADM13474__NA

SEQ ID NO: 21874 - RNA, 1410 nt, Artificial Sequence
  derived and/or modified CDS sequence (AUadapt) from InfluenzaA__ADM14469__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcaugcgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaccggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21875 - RNA, 1410 nt, Artificial Sequence; identical to SEQ ID NO: 16318
  derived and/or modified CDS sequence (AUadapt) from InfluenzaA__ADM14479__NA

SEQ ID NO: 21876 - RNA, 1410 nt, Artificial Sequence; identical to SEQ ID NO: 16318
  derived and/or modified CDS sequence (AUadapt) from InfluenzaA__ADM14499__NA

SEQ ID NO: 21877 - RNA, 1410 nt, Artificial Sequence; identical to SEQ ID NO: 20653
  derived and/or modified CDS sequence (AUadapt) from InfluenzaA__ADM14518__NA

SEQ ID NO: 21878 - RNA, 1410 nt, Artificial Sequence; identical to SEQ ID NO: 21478
  derived and/or modified CDS sequence (AUadapt) from InfluenzaA__ADM14527__NA

SEQ ID NO: 21879 - RNA, 1410 nt, Artificial Sequence; identical to SEQ ID NO: 20571
  derived and/or modified CDS sequence (AUadapt) from InfluenzaA__ADM14537__NA

SEQ ID NO: 21880 - RNA, 1410 nt, Artificial Sequence; identical to SEQ ID NO: 16318
  derived and/or modified CDS sequence (AUadapt) from InfluenzaA__ADM14546__NA

SEQ ID NO: 21881 - RNA, 1410 nt, Artificial Sequence
  derived and/or modified CDS sequence (AUadapt) from InfluenzaA__ADM14555__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuuccgcuacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 21882 - RNA, 1410 nt, Artificial Sequence; identical to SEQ ID NO: 16318
  derived and/or modified CDS sequence (AUadapt) from InfluenzaA__ADM14573__NA

SEQ ID NO: 21883 - RNA, 1410 nt, Artificial Sequence; identical to SEQ ID NO: 16318
  derived and/or modified CDS sequence (AUadapt) from InfluenzaA__ADM14582__NA

SEQ ID NO: 21884 - RNA, 1410 nt, Artificial Sequence; identical to SEQ ID NO: 16318
  derived and/or modified CDS sequence (AUadapt) from InfluenzaA__ADM14591__NA

SEQ ID NO: 21885 - RNA, 1410 nt, Artificial Sequence
  derived and/or modified CDS sequence (AUadapt) from InfluenzaA__ADM14601__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucaacggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacucccgguucgagagcguggccuggagcgcguccgccugccacgacgggaucaacuggcucaccaucggcaucucgggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucucguucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 21886 - RNA, 1410 nt, Artificial Sequence
  derived and/or modified CDS sequence (AUadapt) from InfluenzaA__ADM14611__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcugucggggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgccuccgcgugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgccugcgugaacggguccugcuucaccgugaugaccgacggcccgagcgacggccaggcguccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21887 - RNA, 1410 nt, Artificial Sequence; identical to SEQ ID NO: 16318
  derived and/or modified CDS sequence (AUadapt) from InfluenzaA__ADM14620__NA

SEQ ID NO: 21888 - RNA, 1410 nt, Artificial Sequence; identical to SEQ ID NO: 16318
  derived and/or modified CDS sequence (AUadapt) from InfluenzaA__ADM14629__NA

SEQ ID NO: 21889 - RNA, 1410 nt, Artificial Sequence; identical to SEQ ID NO: 16318
  derived and/or modified CDS sequence (AUadapt) from InfluenzaA__ADM14639__NA

SEQ ID NO: 21890 - RNA, 1410 nt, Artificial Sequence; identical to SEQ ID NO: 16318
  derived and/or modified CDS sequence (AUadapt) from InfluenzaA__ADM14657__NA

SEQ ID NO: 21891 - RNA, 1410 nt, Artificial Sequence; identical to SEQ ID NO: 16318
  derived and/or modified CDS sequence (AUadapt) from InfluenzaA__ADM14666__NA

SEQ ID NO: 21892 - RNA, 1410 nt, Artificial Sequence; identical to SEQ ID NO: 16318
  derived and/or modified CDS sequence (AUadapt) from InfluenzaA__ADM14684__NA

SEQ ID NO: 21893 - RNA, 1410 nt, Artificial Sequence
  derived and/or modified CDS sequence (AUadapt) from InfluenzaA__ADM14693__NA
augaaccccaaccagaagaugaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21894 - RNA, 1410 nt, Artificial Sequence
  derived and/or modified CDS sequence (AUadapt) from InfluenzaA__ADM14702__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcucccaccuggagugccgcaccuucuuccugacccagggcgcccuccugaacgacaagcacagcaacgggaccaucaaggaccggucccccuaccgcacgcugaugagcugccccaucggcgaggucccgucccccuacaacucgcgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccucggagaucacgugcgugugccgggacaacuggcacggcuccaaccgccccugggucagcuucaaccagaaccucgaguaccagaucggguacaucugcuccggcaucuucggggacaacccccggccgaacgacaagaccggcagcugcggccccguguccagcaacggggccaacggcgugaagggguucuccuucaaguacggcaacggggccuggaucggccgcaccaagucgaccagcucccggaacggcuucgagaugaucugggaccccaacggguggaccggcacggacaacaacuucagcaucaagcaggacaucgucgggaucaacgagugguccggcuacucgggguccuucgugcagcaccccgagcugaccggccuggacugcauccgcccgugcuucuggguggagcucauccggggccgccccaaggagaacaccaucuggaccagcggguccagcaucuccuucugcggcgucaacagcgacacgguggggugguccuggcccgacggcgcggagcugcccuucaccaucgacaaguga

SEQ ID NO: 21895 - RNA, 1410 nt, Artificial Sequence; identical to SEQ ID NO: 21042
  derived and/or modified CDS sequence (AUadapt) from InfluenzaA__ADM14711__NA

SEQ ID NO: 21896 - RNA, 1410 nt, Artificial Sequence
  derived and/or modified CDS sequence (AUadapt) from InfluenzaA__ADM14720__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcguguucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21897 - RNA, 1410 nt, Artificial Sequence
  derived and/or modified CDS sequence (AUadapt) from InfluenzaA__ADM14730__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccgucuacuccaaggacaacagcauccgcaucggcuccaagggggacgugcuggugauccgggagcccuucaucagcugcucgccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucguggggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21898 - RNA, 1350 nt, Artificial Sequence
  derived and/or modified CDS sequence (AUadapt) from InfluenzaA__ADM14748__NA
augaaccccaaccagaagaucaucaccaucggcucggugugcaugaccaucgggauggccaaccugauccuccagaucggcaacaucaucuccaucuggaucucgcacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacucgucccucugcccggucagcggcugggccaucuacuccaaggacaacucgauccgcaucugccggaccuucuuccugacccagggcgcccugcucaacgacaagcacuccaacgggaccaucaaggaccgcucgcccuaccggacgcugauguccugccccaucggcgaggugcccagcccguacaacucccgcuucgagucgguggccugguccgcgucggccugccacgacgggaucaacuggcugaccaucggcaucagcgggcccgacaacggcgccgucgccgugcucaaguacaacggcaucaucaccgacaccaucaaguccuggcggaacaacauccugcgcacgcaggagucggagugcgcgugcgugaacggguccugcuucaccgucaugaccgacggccccucggacgggcaggccuccuacaagaucuuccggaucgagaagggcaagaucgucaagagcguggagaugaacgcccccaacuaccacuacgaggagugcuccugcuacccggacucguccgagaucacgugcgugugccgcgacaacuggcacggcucgaaccggcccuggguguccuucaaccagaaccuggaguaccagaucggguacaucugcagcggcaucuucggggacaacccccgccccaacgacaagaccggcuccugcgggccggugucguccaacggcgccaacggcgucaagggguucucguucaaguacggcaacgggguguggaucggccggaccaaguccaucagcucccgcaacggguucgagaugaucugggaccccaacggcuggaccggcaccgacaacaacuucucgaucaagcaggacaucguggggaucaacgaguggucgggcuacuccgggagcuucguccagcaccccgagcucacgggccuggacugcauccggcccugcuucuggguggagcugauccgcgggcggccgaaggagaacaccaucuggaccuccggcucguccaucucguucugcggcgugaacuccgacaccgucggguggagcuggcccgacggcgccgagcuccccuucacgaucgacaaguga

SEQ ID NO: 21899 - RNA, 1410 nt, Artificial Sequence
  derived and/or modified CDS sequence (AUadapt) from InfluenzaA__ADM14758__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21900 - RNA, 1410 nt, Artificial Sequence; identical to SEQ ID NO: 21899
  derived and/or modified CDS sequence (AUadapt) from InfluenzaA__ADM14767__NA

SEQ ID NO: 21901 - RNA, 1410 nt, Artificial Sequence; identical to SEQ ID NO: 16318
  derived and/or modified CDS sequence (AUadapt) from InfluenzaA__ADM14777__NA

SEQ ID NO: 21902 - RNA, 1410 nt, Artificial Sequence; identical to SEQ ID NO: 16318
  derived and/or modified CDS sequence (AUadapt) from InfluenzaA__ADM14814__NA

SEQ ID NO: 21903 - RNA, 1410 nt, Artificial Sequence; identical to SEQ ID NO: 16318
  derived and/or modified CDS sequence (AUadapt) from InfluenzaA__ADM14823__NA

SEQ ID NO: 21904 - RNA, 1410 nt, Artificial Sequence; identical to SEQ ID NO: 20763
  derived and/or modified CDS sequence (AUadapt) from InfluenzaA__ADM14841__NA

SEQ ID NO: 21905 - RNA, 1410 nt, Artificial Sequence; identical to SEQ ID NO: 20763
  derived and/or modified CDS sequence (AUadapt) from InfluenzaA__ADM14859__NA

SEQ ID NO: 21906 - RNA, 1410 nt, Artificial Sequence; identical to SEQ ID NO: 20277
  derived and/or modified CDS sequence (AUadapt) from InfluenzaA__ADM14868__NA

SEQ ID NO: 21907 - RNA, 1410 nt, Artificial Sequence; identical to SEQ ID NO: 20763
  derived and/or modified CDS sequence (AUadapt) from InfluenzaA__ADM14878__NA

SEQ ID NO: 21908 - RNA, 1410 nt, Artificial Sequence; identical to SEQ ID NO: 16318
  derived and/or modified CDS sequence (AUadapt) from InfluenzaA__ADM14887__NA

SEQ ID NO: 21909 - RNA, 1410 nt, Artificial Sequence
  derived and/or modified CDS sequence (AUadapt) from InfluenzaA__ADM14896__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacgugcuggugauccgggagcccuucaucagcugcucgccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21910 - RNA, 1410 nt, Artificial Sequence; identical to SEQ ID NO: 16318
  derived and/or modified CDS sequence (AUadapt) from InfluenzaA__ADM14905__NA

SEQ ID NO: 21911 - RNA, 1410 nt, Artificial Sequence; identical to SEQ ID NO: 16318
  derived and/or modified CDS sequence (AUadapt) from InfluenzaA__ADM14923__NA

SEQ ID NO: 21912 - RNA, 1410 nt, Artificial Sequence; identical to SEQ ID NO: 20428
  derived and/or modified CDS sequence (AUadapt) from InfluenzaA__ADM14932__NA

SEQ ID NO: 21913 - RNA, 1410 nt, Artificial Sequence; identical to SEQ ID NO: 16318
  derived and/or modified CDS sequence (AUadapt) from InfluenzaA__ADM14950__NA

SEQ ID NO: 21914 - RNA, 1410 nt, Artificial Sequence; identical to SEQ ID NO: 20158
  derived and/or modified CDS sequence (AUadapt) from InfluenzaA__ADM14959__NA

SEQ ID NO: 21915 - RNA, 1410 nt, Artificial Sequence
  derived and/or modified CDS sequence (AUadapt) from InfluenzaA__ADM14977__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucaacggcugggccaucuacagcaaggacaacuccgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacucccgguucgagagcguggccuggagcgcguccgccugccacgacgggaucaacuggcucaccaucggcaucucgggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcaacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucucguucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 21916 - RNA, 1410 nt, Artificial Sequence; identical to SEQ ID NO: 20763
  derived and/or modified CDS sequence (AUadapt) from InfluenzaA__ADM14987__NA

SEQ ID NO: 21917 - RNA, 1410 nt, Artificial Sequence; identical to SEQ ID NO: 20307
  derived and/or modified CDS sequence (AUadapt) from InfluenzaA__ADM26787__NA

SEQ ID NO: 21918 - RNA, 1410 nt, Artificial Sequence; identical to SEQ ID NO: 20886
  derived and/or modified CDS sequence (AUadapt) from InfluenzaA__ADM26798__NA

SEQ ID NO: 21919 - RNA, 1410 nt, Artificial Sequence
  derived and/or modified CDS sequence (AUadapt) from InfluenzaA__ADM26809__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacggugaacaacguccacuccaacaacaccgugcgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccgucgugucgugguccaaggagauccugcgcacccaggagagcgagugcgugugcaucaacggcacgugcaccgucgugaugaccgacggguccgccucgggcaaggccgacaccaagauccuguucaucgaggagggcaagaucgugcacacgagcacccucuccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccuggaccccaacaacgaggagggcgggcacggggugaagggcugggccuucgacgacgggaacgacgucuggaugggccgcaccaucucggagaagucccggcucggcuacgagaccuucaaggugaucgagggguggagcaaccacaaguccaagcugcagaucaaccgccaggugaucgucgaccggggcaaccgcucgggguacuccggcaucuucagcguggagggcaagucgugcaucaaccggugcuucuacguggagcugauccgcgggcggaaggaggagaccgagguccucuggaccuccaacagcaucgugguguucugcggcaccuccgggacguacggcaccgggagcuggcccgacggcgccgaccugaaccugaugccgaucuga

SEQ ID NO: 21920 - RNA, 1410 nt, Artificial Sequence
  derived and/or modified CDS sequence (AUadapt) from InfluenzaA__ADM26820__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 21921 - RNA, 1350 nt, Artificial Sequence
  derived and/or modified CDS sequence (AUadapt) from InfluenzaA__ADM31427__NA
augaaucccaaccagaagaucaucaccaucggcucggugugcaugaucaucgggaucgucucccugaugcuccagaucggcaacaugaucagcaucugggugucccacagcauccagaccgggaaccagcaucaggccgagccgauccgcaacacgaacuuccugaccgagaacgccguggcguccgucacccuggccggcaacagcucccucugccccauccgggggugggccgugcacagcaaggauaacuccauccgcaucggcagcaagggcgacguguucgucauccgggagcccuucaucuccugcagccacauggagugccgcaccuuuuuccugacgcagggggcccugcucaacgacaagcacuccaacggcaccgugaaggaccggagcccccaccgcacccugauguccuguccggugggggaggcccccagccccuacaacucccgguucgagucggucgcgugguccgccagcgccugccacgacggcaucaguuggcugaccaucgggaucuccggccccgacaacggcgccguggcggugcucaaguacaacgggaucaucacggacaccaucaagagcuggggcaacaacauccugcgcacccaggaguccgagugcgccugugucaacgggagcugcuucaccgugaugacggacggcccguccaacggccaggccagcuacaagaucuucaagaucgagaaggggaagguggucaaguccguggagcugaaugcccccaacuaccacuacgaggagugcagcugcuaccccgauuccggcgagaucaucugcgugugccgggacaacuggcacgggagcaaccgccccugggucuccuucaaccagaaucucgaguaccagaucggcuacaucugcagcgggguguucggcgacaacccgcggcccaacgacggcaccggguccuguggccccaugucgcccaacggggccuacggcaucaagggguucuccuucaaguacggcaacggcguguggaucgggcgcaccaagagcaccaauucccggagcggcuucgagaugaucugggacccgaacggguggacgggcaccgacuccgaguucagcgucaagcaggacaucguggcgaucaccgacuggaguggguacuccggcagcuucgugcagcaccccgagcugaccggccuggacugcauccgccccugcuucugggucgagcucauccgggggcgccccaaggaguccacgaucuggaccagcggcuccaguaucuccuucugcggggugaacagcgacaccgucuccuggagcuggccggacggcgccgagcugcccuucaccaucgacaaguga

SEQ ID NO: 21922 - RNA, 1410 nt, Artificial Sequence
  derived and/or modified CDS sequence (AUadapt) from InfluenzaA__ADM31481__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaagggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21923 - RNA, 1410 nt, Artificial Sequence; identical to SEQ ID NO: 19723
  derived and/or modified CDS sequence (AUadapt) from InfluenzaA__ADM31491__NA

SEQ ID NO: 21924 - RNA, 1410 nt, Artificial Sequence; identical to SEQ ID NO: 21345
  derived and/or modified CDS sequence (AUadapt) from InfluenzaA__ADM31501__NA

SEQ ID NO: 21925 - RNA, 1410 nt, Artificial Sequence; identical to SEQ ID NO: 16318
  derived and/or modified CDS sequence (AUadapt) from InfluenzaA__ADM31511__NA

SEQ ID NO: 21926 - RNA, 1410 nt, Artificial Sequence; identical to SEQ ID NO: 21341
  derived and/or modified CDS sequence (AUadapt) from InfluenzaA__ADM31521__NA

SEQ ID NO: 21927 - RNA, 1410 nt, Artificial Sequence; identical to SEQ ID NO: 16318
  derived and/or modified CDS sequence (AUadapt) from InfluenzaA__ADM31531__NA

SEQ ID NO: 21928 - RNA, 1410 nt, Artificial Sequence; identical to SEQ ID NO: 20428
  derived and/or modified CDS sequence (AUadapt) from InfluenzaA__ADM31541__NA

SEQ ID NO: 21929 - RNA, 1410 nt, Artificial Sequence; identical to SEQ ID NO: 16318
  derived and/or modified CDS sequence (AUadapt) from InfluenzaA__ADM31551__NA

SEQ ID NO: 21930 - RNA, 1410 nt, Artificial Sequence; identical to SEQ ID NO: 16318
  derived and/or modified CDS sequence (AUadapt) from InfluenzaA__ADM31561__NA

SEQ ID NO: 21931 - RNA, 1410 nt, Artificial Sequence; identical to SEQ ID NO: 16318
  derived and/or modified CDS sequence (AUadapt) from InfluenzaA__ADM31571__NA

SEQ ID NO: 21932 - RNA, 1410 nt, Artificial Sequence; identical to SEQ ID NO: 20317
  derived and/or modified CDS sequence (AUadapt) from InfluenzaA__ADM31581__NA

SEQ ID NO: 21933 - RNA, 1410 nt, Artificial Sequence; identical to SEQ ID NO: 16318
  derived and/or modified CDS sequence (AUadapt) from InfluenzaA__ADM31601__NA

SEQ ID NO: 21934 - RNA, 1410 nt, Artificial Sequence; identical to SEQ ID NO: 20428
  derived and/or modified CDS sequence (AUadapt) from InfluenzaA__ADM31611__NA

SEQ ID NO: 21935 - RNA, 1410 nt, Artificial Sequence
  derived and/or modified CDS sequence (AUadapt) from InfluenzaA__ADM31621__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcuccagccuggagugccgcaccuucuuccugacccagggcgcccuccugaacgacaagcacuccaacgggaccaucaaggaccggucgcccuaccgcacgcugauguccugccccaucggcgaggucccgagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggccccagcgacggccaggccuccuacaagaucuuccgcaucgagaaggggaagaucgucaagagcguggagaugaacgccccgaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccccggccgaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcaccccgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 21936 - RNA, 1410 nt, Artificial Sequence; identical to SEQ ID NO: 20428
  derived and/or modified CDS sequence (AUadapt) from InfluenzaA__ADM31631__NA

SEQ ID NO: 21937 - RNA, 1410 nt, Artificial Sequence; identical to SEQ ID NO: 20317
  derived and/or modified CDS sequence (AUadapt) from InfluenzaA__ADM31641__NA

SEQ ID NO: 21938 - RNA, 1410 nt, Artificial Sequence; identical to SEQ ID NO: 20602
  derived and/or modified CDS sequence (AUadapt) from InfluenzaA__ADM31651__NA

SEQ ID NO: 21939 - RNA, 1410 nt, Artificial Sequence; identical to SEQ ID NO: 20317
  derived and/or modified CDS sequence (AUadapt) from InfluenzaA__ADM31661__NA

SEQ ID NO: 21940 - RNA, 1410 nt, Artificial Sequence
  derived and/or modified CDS sequence (AUadapt) from InfluenzaA__ADM31671__NA
augaaccccaaccagaagaucaucaccaucggcucggugugcaugaccaucgggauggccaaccugauccuccagaucggcaacaucaucuccaucuggaucagccacuccacgcagcuggggaaccagaaccagaucgagaccugcaaccagagcgucaucaccuacgagaacaacaccugggugaaccagacguacgugaacaucuccaacaccaacuucgccgcgggccagucggucguguccgccaagcuggccgggaacagcucccucugcccggugagcggcugggccaucuacuccaaggacaacagcauccgcaucggcuccaagggggacgucuucgugauccgggagcccuucaucucgugcagcccccuggagugccgcaccuucuuccugacccagggcgcccuccugaacgacaagcacuccaacgggacgaucaaggaccggucccccuaccgcacccugaugagcugcccgaucggcgaggugcccucccccuacaacucgcgguucgagagcgucgcgugguccgccagcgccugccacgacgggaucaacuggcucaccaucggcaucuccggccccgacaacggggccguggcggugcugaaguacaacggcaucaucaccgacacgaucaagagcuggcgcaacaacauccugcggacccaggaguccgagugcgccugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccucggagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagucgaucagcucccggaacggcuucgagaugaucugggaccccaacggguggaccggcacggacaacaacuucagcaucaagcaggacaucgucgggaucaacgagugguccggcuacucgggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgcggagcugccguucaccaucgacaaguga

SEQ ID NO: 21941 - RNA, 1410 nt, Artificial Sequence; identical to SEQ ID NO: 20428
  derived and/or modified CDS sequence (AUadapt) from InfluenzaA__ADM31681__NA

SEQ ID NO: 21942 - RNA, 1410 nt, Artificial Sequence
  derived and/or modified CDS sequence (AUadapt) from InfluenzaA__ADM31691__NA
augaaccccaaccagaagauccugaccaucggcucggugugcaugaccaucgggauggccaaccucauccugcagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccucgacugcauccgccccugcuucugggucgagcugauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21943 - RNA, 1410 nt, Artificial Sequence; identical to SEQ ID NO: 16318
  derived and/or modified CDS sequence (AUadapt) from InfluenzaA__ADM31701__NA

SEQ ID NO: 21944 - RNA, 1410 nt, Artificial Sequence; identical to SEQ ID NO: 16318
  derived and/or modified CDS sequence (AUadapt) from InfluenzaA__ADM31711__NA

SEQ ID NO: 21945 - RNA, 1410 nt, Artificial Sequence; identical to SEQ ID NO: 20428
  derived and/or modified CDS sequence (AUadapt) from InfluenzaA__ADM31721__NA

SEQ ID NO: 21946 - RNA, 1410 nt, Artificial Sequence
  derived and/or modified CDS sequence (AUadapt) from InfluenzaA__ADM31731__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggcggaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucucgucccgcaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgccgagcugccguucaccaucgacaaguga

SEQ ID NO: 21947 - RNA, 1410 nt, Artificial Sequence; identical to SEQ ID NO: 21515
  derived and/or modified CDS sequence (AUadapt) from InfluenzaA__ADM31741__NA

SEQ ID NO: 21948 - RNA, 1410 nt, Artificial Sequence; identical to SEQ ID NO: 16318
  derived and/or modified CDS sequence (AUadapt) from InfluenzaA__ADM31751__NA

SEQ ID NO: 21949 - RNA, 1410 nt, Artificial Sequence
  derived and/or modified CDS sequence (AUadapt) from InfluenzaA__ADM31761__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccacaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucagcaucaagcaggacaucguggggaucuccgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21950 - RNA, 1410 nt, Artificial Sequence
  derived and/or modified CDS sequence (AUadapt) from InfluenzaA__ADM31771__NA
augaaccccaaccagaagauccugaccaucggcucggugugcaugaccaucgggauggccaaccucauccugcagaucggcaacaucaucuccaucuggaucagccacuccauccagcuggggaaccagaaccagacggagaccugcaaccagagcgucaucaucuacgagaacaacaccugggugaaccagaccuacgugaacaucuccaacacgaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 21951 - RNA, 1410 nt, Artificial Sequence
  derived and/or modified CDS sequence (AUadapt) from InfluenzaA__ADM31801__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucaacaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaaguucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 21952 - RNA, 1410 nt, Artificial Sequence
  derived and/or modified CDS sequence (AUadapt) from InfluenzaA__ADM31811__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaaguucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 21953 - RNA, 1410 nt, Artificial Sequence; identical to SEQ ID NO: 20317
  derived and/or modified CDS sequence (AUadapt) from InfluenzaA__ADM31821__NA

SEQ ID NO: 21954 - RNA, 1410 nt, Artificial Sequence; identical to SEQ ID NO: 16318
  derived and/or modified CDS sequence (AUadapt) from InfluenzaA__ADM31831__NA

SEQ ID NO: 21955 - RNA, 1410 nt, Artificial Sequence; identical to SEQ ID NO: 16318
  derived and/or modified CDS sequence (AUadapt) from InfluenzaA__ADM31841__NA

SEQ ID NO: 21956 - RNA, 1410 nt, Artificial Sequence
  derived and/or modified CDS sequence (AUadapt) from InfluenzaA__ADM31851__NA
augaaccccaaccagaagauccugaccaucggcucggugugcaugaccaucgggauggccaaccucauccugcagaucggcaacaucaucuccaucuggaucagccacuccauccagcuggggaaccagaaccagacggagaccugcaaccagagcgucaucaccuacgagaacaacaccugggugaaccagacguacgugaacaucuccaacaccaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggacgaucaaggaccggucccccuaccgcacccucaugagcugcccgaucggcgagguccccucccccuacaacagccgguucgagagcguggccugguccgcgucggccugccacgacgggaucaacuggcugaccaucggcaucuccggccccgacaacggggccguggccguccugaaguacaacggcaucaucaccgacacgaucaagagcuggcgcaacaacauccuccggacccaggaguccgagugcgcgugcgugaacgggagcugcuucaccgugaugaccgacggcccguccgacggccaggccagcuacaagaucuuccgcaucgagcgggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccuggaguaccagaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaucagcucccgcaacggcuucgagaugaucugggaccccaacggguggaccggcacggacaacaacuucagcaucaagcaggacaucguggggaucaacgagugguccggcuacucgggguccuucgugcagcacccggagcugaccggccucgacugcauccggcccugcuucugggucgagcugauccgcggccggcccaaggagaacaccaucuggaccagcggguccagcaucuccuucugcggcgugaacagcgacacggucgggugguccuggcccgacggcgccgagcugccguucaccaucgacaaguga

SEQ ID NO: 21957 - RNA, 1410 nt, Artificial Sequence; identical to SEQ ID NO: 16318
  derived and/or modified CDS sequence (AUadapt) from InfluenzaA__ADM31861__NA

SEQ ID NO: 21958 - RNA, 1410 nt, Artificial Sequence; identical to SEQ ID NO: 16318
  derived and/or modified CDS sequence (AUadapt) from InfluenzaA__ADM31871__NA

SEQ ID NO: 21959 - RNA, 1410 nt, Artificial Sequence
  derived and/or modified CDS sequence (AUadapt) from InfluenzaA__ADM31881__NA
augaaccccaaccagaagaucaucaccaucggcucggugugcaugaccaucgggauggccaaccugauccuccagaucggcaacacgaucuccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 21960 - RNA, 1410 nt, Artificial Sequence; identical to SEQ ID NO: 16318
  derived and/or modified CDS sequence (AUadapt) from InfluenzaA__ADM31891__NA

SEQ ID NO: 21961 - RNA, 1410 nt, Artificial Sequence; identical to SEQ ID NO: 16274
  derived and/or modified CDS sequence (AUadapt) from InfluenzaA__ADM31901__NA

SEQ ID NO: 21962 - RNA, 1410 nt, Artificial Sequence; identical to SEQ ID NO: 20363
  derived and/or modified CDS sequence (AUadapt) from InfluenzaA__ADM31911__NA

SEQ ID NO: 21963 - RNA, 1410 nt, Artificial Sequence; identical to SEQ ID NO: 20363
  derived and/or modified CDS sequence (AUadapt) from InfluenzaA__ADM31921__NA

SEQ ID NO: 21964 - RNA, 1410 nt, Artificial Sequence; identical to SEQ ID NO: 20821
  derived and/or modified CDS sequence (AUadapt) from InfluenzaA__ADM31931__NA

SEQ ID NO: 21965 - RNA, 1410 nt, Artificial Sequence; identical to SEQ ID NO: 16274
  derived and/or modified CDS sequence (AUadapt) from InfluenzaA__ADM31941__NA

SEQ ID NO: 21966 - RNA, 1410 nt, Artificial Sequence; identical to SEQ ID NO: 20821
  derived and/or modified CDS sequence (AUadapt) from InfluenzaA__ADM31951__NA

SEQ ID NO: 21967 - RNA, 1410 nt, Artificial Sequence
  derived and/or modified CDS sequence (AUadapt) from InfluenzaA__ADM31961__NA
augaaccccaaccagaagaucaucaccaucggcucggugugcauggccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgcggccggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggcgugguccgccagcgccugccacgacgggaucaacuggcucacgaucggcaucuccggccccgacaacggggccguggcgguccugaaguacaacggcaucaucaccgacaccaucaagagcuggcgcaacaacauccugcggacccaggaguccgagugcgccugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgcggagcugccguucaccaucgacaaguga

SEQ ID NO: 21968 - RNA, 1410 nt, Artificial Sequence
  derived and/or modified CDS sequence (AUadapt) from InfluenzaA__ADM31971__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacucgucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcgugaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 21969 - RNA, 1410 nt, Artificial Sequence; identical to SEQ ID NO: 20363
  derived and/or modified CDS sequence (AUadapt) from InfluenzaA__ADM31981__NA

SEQ ID NO: 21970 - RNA, 1410 nt, Artificial Sequence; identical to SEQ ID NO: 16274
  derived and/or modified CDS sequence (AUadapt) from InfluenzaA__ADM31991__NA

SEQ ID NO: 21971 - RNA, 1410 nt, Artificial Sequence; identical to SEQ ID NO: 16274
  derived and/or modified CDS sequence (AUadapt) from InfluenzaA__ADM32001__NA

SEQ ID NO: 21972 - RNA, 1410 nt, Artificial Sequence; identical to SEQ ID NO: 16274
  derived and/or modified CDS sequence (AUadapt) from InfluenzaA__ADM32011__NA

SEQ ID NO: 21973 - RNA, 1410 nt, Artificial Sequence; identical to SEQ ID NO: 16318
  derived and/or modified CDS sequence (AUadapt) from InfluenzaA__ADM32021__NA

SEQ ID NO: 21974 - RNA, 1410 nt, Artificial Sequence; identical to SEQ ID NO: 20110
  derived and/or modified CDS sequence (AUadapt) from InfluenzaA__ADM32031__NA

SEQ ID NO: 21975 - RNA, 1410 nt, Artificial Sequence; identical to SEQ ID NO: 20864
  derived and/or modified CDS sequence (AUadapt) from InfluenzaA__ADM32051__NA

SEQ ID NO: 21976 - RNA, 1410 nt, Artificial Sequence; identical to SEQ ID NO: 16318
  derived and/or modified CDS sequence (AUadapt) from InfluenzaA__ADM32061__NA

SEQ ID NO: 21977 - RNA, 1410 nt, Artificial Sequence; identical to SEQ ID NO: 16318
  derived and/or modified CDS sequence (AUadapt) from InfluenzaA__ADM32071__NA

SEQ ID NO: 21978 - RNA, 1410 nt, Artificial Sequence; identical to SEQ ID NO: 16318
  derived and/or modified CDS sequence (AUadapt) from InfluenzaA__ADM32081__NA

SEQ ID NO: 21979 - RNA, 1410 nt, Artificial Sequence; identical to SEQ ID NO: 20363
  derived and/or modified CDS sequence (AUadapt) from InfluenzaA__ADM32091__NA

SEQ ID NO: 21980 - RNA, 1410 nt, Artificial Sequence; identical to SEQ ID NO: 16318
  derived and/or modified CDS sequence (AUadapt) from InfluenzaA__ADM32101__NA

SEQ ID NO: 21981 - RNA, 1410 nt, Artificial Sequence; identical to SEQ ID NO: 16318
  derived and/or modified CDS sequence (AUadapt) from InfluenzaA__ADM32111__NA

SEQ ID NO: 21982 - RNA, 1410 nt, Artificial Sequence; identical to SEQ ID NO: 20821
  derived and/or modified CDS sequence (AUadapt) from InfluenzaA__ADM32554__NA

SEQ ID NO: 21983 - RNA, 1410 nt, Artificial Sequence; identical to SEQ ID NO: 16274
  derived and/or modified CDS sequence (AUadapt) from InfluenzaA__ADM32564__NA

SEQ ID NO: 21984 - RNA, 1410 nt, Artificial Sequence; identical to SEQ ID NO: 20363
  derived and/or modified CDS sequence (AUadapt) from InfluenzaA__ADM32574__NA

SEQ ID NO: 21985 - RNA, 1410 nt, Artificial Sequence; identical to SEQ ID NO: 16318
  derived and/or modified CDS sequence (AUadapt) from InfluenzaA__ADM32584__NA

SEQ ID NO: 21986 - RNA, 1410 nt, Artificial Sequence; identical to SEQ ID NO: 20821
  derived and/or modified CDS sequence (AUadapt) from InfluenzaA__ADM32594__NA

SEQ ID NO: 21987 - RNA, 1410 nt, Artificial Sequence; identical to SEQ ID NO: 16318
  derived and/or modified CDS sequence (AUadapt) from InfluenzaA__ADM32604__NA

SEQ ID NO: 21988 - RNA, 1410 nt, Artificial Sequence; identical to SEQ ID NO: 16318
  derived and/or modified CDS sequence (AUadapt) from InfluenzaA__ADM32614__NA

SEQ ID NO: 21989 - RNA, 1410 nt, Artificial Sequence; identical to SEQ ID NO: 16318
  derived and/or modified CDS sequence (AUadapt) from InfluenzaA__ADM32624__NA

SEQ ID NO: 21990 - RNA, 1410 nt, Artificial Sequence; identical to SEQ ID NO: 20821
  derived and/or modified CDS sequence (AUadapt) from InfluenzaA__ADM32634__NA

SEQ ID NO: 21991 - RNA, 1410 nt, Artificial Sequence; identical to SEQ ID NO: 16318
  derived and/or modified CDS sequence (AUadapt) from InfluenzaA__ADM32644__NA

SEQ ID NO: 21992 - RNA, 1410 nt, Artificial Sequence; identical to SEQ ID NO: 16318
  derived and/or modified CDS sequence (AUadapt) from InfluenzaA__ADM32664__NA

SEQ ID NO: 21993 - RNA, 1410 nt, Artificial Sequence; identical to SEQ ID NO: 20363
  derived and/or modified CDS sequence (AUadapt) from InfluenzaA__ADM32674__NA

SEQ ID NO: 21994 - RNA, 1410 nt, Artificial Sequence; identical to SEQ ID NO: 16318
  derived and/or modified CDS sequence (AUadapt) from InfluenzaA__ADM32684__NA

SEQ ID NO: 21995 - RNA, 1410 nt, Artificial Sequence; identical to SEQ ID NO: 16274
  derived and/or modified CDS sequence (AUadapt) from InfluenzaA__ADM32694__NA

SEQ ID NO: 21996 - RNA, 1410 nt, Artificial Sequence; identical to SEQ ID NO: 16318
  derived and/or modified CDS sequence (AUadapt) from InfluenzaA__ADM32704__NA

SEQ ID NO: 21997 - RNA, 1410 nt, Artificial Sequence; identical to SEQ ID NO: 20864
  derived and/or modified CDS sequence (AUadapt) from InfluenzaA__ADM32714__NA

SEQ ID NO: 21998 - RNA, 1410 nt, Artificial Sequence; identical to SEQ ID NO: 20864
  derived and/or modified CDS sequence (AUadapt) from InfluenzaA__ADM32724__NA

SEQ ID NO: 21999 - RNA, 1410 nt, Artificial Sequence; identical to SEQ ID NO: 16318
  derived and/or modified CDS sequence (AUadapt) from InfluenzaA__ADM32734__NA

SEQ ID NO: 22000 - RNA, 1410 nt, Artificial Sequence; identical to SEQ ID NO: 20363
  derived and/or modified CDS sequence (AUadapt) from InfluenzaA__ADM32744__NA

SEQ ID NO: 22001 - RNA, 1410 nt, Artificial Sequence; identical to SEQ ID NO: 20864
  derived and/or modified CDS sequence (AUadapt) from InfluenzaA__ADM32754__NA

SEQ ID NO: 22002 - RNA, 1410 nt, Artificial Sequence; identical to SEQ ID NO: 20363
  derived and/or modified CDS sequence (AUadapt) from InfluenzaA__ADM32764__NA

SEQ ID NO: 22003 - RNA, 1410 nt, Artificial Sequence
  derived and/or modified CDS sequence (AUadapt) from InfluenzaA__ADM32774__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucacgaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22004 - RNA, 1410 nt, Artificial Sequence; identical to SEQ ID NO: 20110
  derived and/or modified CDS sequence (AUadapt) from InfluenzaA__ADM32784__NA

SEQ ID NO: 22005 - RNA, 1410 nt, Artificial Sequence; identical to SEQ ID NO: 20363
  derived and/or modified CDS sequence (AUadapt) from InfluenzaA__ADM32794__NA

SEQ ID NO: 22006 - RNA, 1410 nt, Artificial Sequence
  derived and/or modified CDS sequence (AUadapt) from InfluenzaA__ADM32804__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggucgggaacagcucccucugcccggugucgggcugggccaucuacuccaaggacaacagcgugcgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucggucgccugguccgccagcgcgugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgagaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgugggcugguccuggcccgacggggccgagcugccguucacgaucgacaaguga

SEQ ID NO: 22007 - RNA, 1410 nt, Artificial Sequence
  derived and/or modified CDS sequence (AUadapt) from InfluenzaA__ADM32814__NA
augaaccccaaccagaagaucaucaccaucggcucggugugcaugaccaucgggauggccaaccugauccuccagaucggcaacaucaucuccaucuggaucagccacuccauccagcuggggaaccagaaccaggucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22008 - RNA, 1410 nt, Artificial Sequence; identical to SEQ ID NO: 16318
  derived and/or modified CDS sequence (AUadapt) from InfluenzaA__ADM32824__NA

SEQ ID NO: 22009 - RNA, 1410 nt, Artificial Sequence; identical to SEQ ID NO: 20363
  derived and/or modified CDS sequence (AUadapt) from InfluenzaA__ADM32834__NA

SEQ ID NO: 22010 - RNA, 1410 nt, Artificial Sequence; identical to SEQ ID NO: 16274
  derived and/or modified CDS sequence (AUadapt) from InfluenzaA__ADM32844__NA

SEQ ID NO: 22011 - RNA, 1410 nt, Artificial Sequence
  derived and/or modified CDS sequence (AUadapt) from InfluenzaA__ADM32854__NA
augaaccccaaccagaagaucaucaccaucggcucggugugcaccacgaucgggauggccaaccugauccuccagaucggcaacaucaucuccaucuggaucagccacuccauccaguucgggaaccagaaccagaucgagaccugcaaccagagcgucaucaccuacgagaacaacaccugggugaaccagacguacgugaacaucuccaacaccaacuucgccgcgggccagagcgucguguccgugaagcuggucgggaacagcucccugugcccggugucgggcugggccaucuacuccaaggacaacagcgugcgcaucggcuccaagggggacgucuucgugauccgggagcccuucaucagcugcagcccccucgagugccgcaccuucuuccugacccagggcgcccugcucaacgacaagcacuccaacgggacgaucaaggaccggucccccuaccgcacccugaugagcugcccgaucggcgaggugcccucccccuacaacagccgguucgagucggucgccugguccgccagcgcgugccacgacgggaucaacuggcugaccaucggcaucuccggccccgacaacggggccguggccgugcucaaguacaacggcaucaucaccgacacgaucaagagcuggcgcaacaacauccugcggacccaggaguccgagugcgccugcgucaacgggagcugcuucaccgugaugaccgacggcccguccaacggccaggcgagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcacggacaacaacuucagcaucaagcaggacaucgucgggaucaacgagugguccggcuacagcggguccuucgugcagcacccggagcucaccggccuggacugcauccgccccugcuucugggucgagcugauccggggccgccccaaggagaacaccaucuggaccagcggguccagcaucuccuucugcggcgugaacagcgacacgguggggugguccuggcccgacggcgccgagcucccguucaccaucgacaaguga

SEQ ID NO: 22012 - RNA, 1410 nt, Artificial Sequence; identical to SEQ ID NO: 16274
  derived and/or modified CDS sequence (AUadapt) from InfluenzaA__ADM32864__NA

SEQ ID NO: 22013 - RNA, 1410 nt, Artificial Sequence; identical to SEQ ID NO: 16318
  derived and/or modified CDS sequence (AUadapt) from InfluenzaA__ADM32874__NA

SEQ ID NO: 22014 - RNA, 1410 nt, Artificial Sequence
  derived and/or modified CDS sequence (AUadapt) from InfluenzaA__ADM32884__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgucggccagagcgugguguccgucaagcuggcggggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaaguucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22015 - RNA, 1410 nt, Artificial Sequence; identical to SEQ ID NO: 16318
  derived and/or modified CDS sequence (AUadapt) from InfluenzaA__ADM32921__NA

SEQ ID NO: 22016 - RNA, 1410 nt, Artificial Sequence; identical to SEQ ID NO: 16318
  derived and/or modified CDS sequence (AUadapt) from InfluenzaA__ADM32931__NA

SEQ ID NO: 22017 - RNA, 1410 nt, Artificial Sequence
  derived and/or modified CDS sequence (AUadapt) from InfluenzaA__ADM32941__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucaacagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 22018 - RNA, 1410 nt, Artificial Sequence; identical to SEQ ID NO: 16318
  derived and/or modified CDS sequence (AUadapt) from InfluenzaA__ADM32951__NA

SEQ ID NO: 22019 - RNA, 1410 nt, Artificial Sequence; identical to SEQ ID NO: 19723
  derived and/or modified CDS sequence (AUadapt) from InfluenzaA__ADM32960__NA

SEQ ID NO: 22020 - RNA, 1410 nt, Artificial Sequence; identical to SEQ ID NO: 16318
  derived and/or modified CDS sequence (AUadapt) from InfluenzaA__ADM32969__NA

SEQ ID NO: 22021 - RNA, 1410 nt, Artificial Sequence; identical to SEQ ID NO: 16318
  derived and/or modified CDS sequence (AUadapt) from InfluenzaA__ADM32979__NA

SEQ ID NO: 22022 - RNA, 1410 nt, Artificial Sequence; identical to SEQ ID NO: 21042
  derived and/or modified CDS sequence (AUadapt) from InfluenzaA__ADM32988__NA

SEQ ID NO: 22023 - RNA, 1410 nt, Artificial Sequence; identical to SEQ ID NO: 21042
  derived and/or modified CDS sequence (AUadapt) from InfluenzaA__ADM32997__NA

SEQ ID NO: 22024 - RNA, 1410 nt, Artificial Sequence; identical to SEQ ID NO: 16318
  derived and/or modified CDS sequence (AUadapt) from InfluenzaA__ADM33006__NA

SEQ ID NO: 22025 - RNA, 1410 nt, Artificial Sequence; identical to SEQ ID NO: 21042
  derived and/or modified CDS sequence (AUadapt) from InfluenzaA__ADM33015__NA

SEQ ID NO: 22026 - RNA, 1410 nt, Artificial Sequence
  derived and/or modified CDS sequence (AUadapt) from InfluenzaA__ADM33025__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcuccaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22027 - RNA, 1410 nt, Artificial Sequence; identical to SEQ ID NO: 16318
  derived and/or modified CDS sequence (AUadapt) from InfluenzaA__ADM33042__NA

SEQ ID NO: 22028 - RNA, 1410 nt, Artificial Sequence; identical to SEQ ID NO: 16318
  derived and/or modified CDS sequence (AUadapt) from InfluenzaA__ADM33062__NA

SEQ ID NO: 22029 - RNA, 1410 nt, Artificial Sequence
  derived and/or modified CDS sequence (AUadapt) from InfluenzaA__ADM33071__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcaagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacggggacaccgucggcuggagcuggcccgacggcgccgagcugccguucacgaucgacaaguga

SEQ ID NO: 22030 - RNA, 1410 nt, Artificial Sequence; identical to SEQ ID NO: 16318
  derived and/or modified CDS sequence (AUadapt) from InfluenzaA__ADM33081__NA

SEQ ID NO: 22031 - RNA, 1410 nt, Artificial Sequence; identical to SEQ ID NO: 20213
  derived and/or modified CDS sequence (AUadapt) from InfluenzaA__ADM33091__NA

SEQ ID NO: 22032 - RNA, 1410 nt, Artificial Sequence; identical to SEQ ID NO: 20213
  derived and/or modified CDS sequence (AUadapt) from InfluenzaA__ADM33101__NA

SEQ ID NO: 22033 - RNA, 1410 nt, Artificial Sequence; identical to SEQ ID NO: 20213
  derived and/or modified CDS sequence (AUadapt) from InfluenzaA__ADM33111__NA

SEQ ID NO: 22034 - RNA, 1410 nt, Artificial Sequence; identical to SEQ ID NO: 16318
  derived and/or modified CDS sequence (AUadapt) from InfluenzaA__ADM33121__NA

SEQ ID NO: 22035 - RNA, 1410 nt, Artificial Sequence; identical to SEQ ID NO: 16318
  derived and/or modified CDS sequence (AUadapt) from InfluenzaA__ADM33130__NA

SEQ ID NO: 22036 - RNA, 1410 nt, Artificial Sequence; identical to SEQ ID NO: 16318
  derived and/or modified CDS sequence (AUadapt) from InfluenzaA__ADM33139__NA

SEQ ID NO: 22037 - RNA, 1410 nt, Artificial Sequence; identical to SEQ ID NO: 16318
  derived and/or modified CDS sequence (AUadapt) from InfluenzaA__ADM33149__NA

SEQ ID NO: 22038 - RNA, 1410 nt, Artificial Sequence; identical to SEQ ID NO: 16318
  derived and/or modified CDS sequence (AUadapt) from InfluenzaA__ADM33159__NA

SEQ ID NO: 22039 - RNA, 1410 nt, Artificial Sequence; identical to SEQ ID NO: 16318
  derived and/or modified CDS sequence (AUadapt) from InfluenzaA__ADM33169__NA

SEQ ID NO: 22040 - RNA, 1410 nt, Artificial Sequence; identical to SEQ ID NO: 16318
  derived and/or modified CDS sequence (AUadapt) from InfluenzaA__ADM33179__NA

SEQ ID NO: 22041 - RNA, 1410 nt, Artificial Sequence; identical to SEQ ID NO: 16318
  derived and/or modified CDS sequence (AUadapt) from InfluenzaA__ADM33188__NA

SEQ ID NO: 22042 - RNA, 1410 nt, Artificial Sequence; identical to SEQ ID NO: 16318
  derived and/or modified CDS sequence (AUadapt) from InfluenzaA__ADM33197__NA

SEQ ID NO: 22043 - RNA, 1410 nt, Artificial Sequence; identical to SEQ ID NO: 16318
  derived and/or modified CDS sequence (AUadapt) from InfluenzaA__ADM33206__NA

SEQ ID NO: 22044 - RNA, 1410 nt, Artificial Sequence; identical to SEQ ID NO: 16318
  derived and/or modified CDS sequence (AUadapt) from InfluenzaA__ADM33215__NA

SEQ ID NO: 22045 - RNA, 1410 nt, Artificial Sequence; identical to SEQ ID NO: 16318
  derived and/or modified CDS sequence (AUadapt) from InfluenzaA__ADM33224__NA

SEQ ID NO: 22046 - RNA, 1410 nt, Artificial Sequence; identical to SEQ ID NO: 16318
  derived and/or modified CDS sequence (AUadapt) from InfluenzaA__ADM33234__NA

SEQ ID NO: 22047 - RNA, 1410 nt, Artificial Sequence; identical to SEQ ID NO: 19564
  derived and/or modified CDS sequence (AUadapt) from InfluenzaA__ADM33243__NA

SEQ ID NO: 22048 - RNA, 1410 nt, Artificial Sequence; identical to SEQ ID NO: 16318
  derived and/or modified CDS sequence (AUadapt) from InfluenzaA__ADM33253__NA

SEQ ID NO: 22049 - RNA, 1410 nt, Artificial Sequence; identical to SEQ ID NO: 19564
  derived and/or modified CDS sequence (AUadapt) from InfluenzaA__ADM33262__NA

SEQ ID NO: 22050 - RNA, 1410 nt, Artificial Sequence; identical to SEQ ID NO: 19170
  derived and/or modified CDS sequence (AUadapt) from InfluenzaA__ADM33272__NA

SEQ ID NO: 22051 - RNA, 1410 nt, Artificial Sequence; identical to SEQ ID NO: 19170
  derived and/or modified CDS sequence (AUadapt) from InfluenzaA__ADM33282__NA

SEQ ID NO: 22052 - RNA, 1410 nt, Artificial Sequence; identical to SEQ ID NO: 16318
  derived and/or modified CDS sequence (AUadapt) from InfluenzaA__ADM33292__NA

SEQ ID NO: 22053 - RNA, 1410 nt, Artificial Sequence; identical to SEQ ID NO: 16318
  derived and/or modified CDS sequence (AUadapt) from InfluenzaA__ADM33302__NA

SEQ ID NO: 22054 - RNA, 1410 nt, Artificial Sequence; identical to SEQ ID NO: 16274
  derived and/or modified CDS sequence (AUadapt) from InfluenzaA__ADM33312__NA

SEQ ID NO: 22055 - RNA, 1410 nt, Artificial Sequence; identical to SEQ ID NO: 19170
  derived and/or modified CDS sequence (AUadapt) from InfluenzaA__ADM33322__NA

SEQ ID NO: 22056 - RNA, 1410 nt, Artificial Sequence; identical to SEQ ID NO: 19170
  derived and/or modified CDS sequence (AUadapt) from InfluenzaA__ADM33332__NA

SEQ ID NO: 22057 - RNA, 1410 nt, Artificial Sequence; identical to SEQ ID NO: 19170
  derived and/or modified CDS sequence (AUadapt) from InfluenzaA__ADM33342__NA

SEQ ID NO: 22058 - RNA, 1410 nt, Artificial Sequence
  derived and/or modified CDS sequence (AUadapt) from InfluenzaA__ADM33367__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucgugaccuacgagaacaacaccugggugaaccagaccuacgucaacaucuccaacacgaacuucgccgcgggccagagcgugguguccgucaagcuggccgggaacucgucccucugcccggugggcggcugggccaucuacagcaaggacaacuccgugcgcaucgggagcaagggcgacgucuucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacucccgguucgagagcgucgccuggagcgcguccgccugccacgacggcaucaacuggcucaccaucggcaucucggggcccgacaacggcgccguggccgugcugaaguacaacgggaucaucaccgacaccaucaaguccuggcgcaacaacauccugcggacgcaggagagcgagugcgcgugcgucaacggcuccugcuucaccgugaugaccgacggcccgagcaacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgucagcuccaacggcgccaacggggugaagggcuucucguucaaguacgggaacggcguguggaucggccgcaccaaguccaucagcagccggaacggguucgagaugaucugggaccccaacggcuggaccgggaccgacaacaacuucuccaucaagcaggacaucgucggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgugggcuggagcuggcccgacggcgccgagcugccguucacgaucgacaaguga

SEQ ID NO: 22059 - RNA, 1410 nt, Artificial Sequence; identical to SEQ ID NO: 19170
  derived and/or modified CDS sequence (AUadapt) from InfluenzaA__ADM33377__NA

SEQ ID NO: 22060 - RNA, 1410 nt, Artificial Sequence; identical to SEQ ID NO: 19170
  derived and/or modified CDS sequence (AUadapt) from InfluenzaA__ADM33387__NA

SEQ ID NO: 22061 - RNA, 1410 nt, Artificial Sequence; identical to SEQ ID NO: 16318
  derived and/or modified CDS sequence (AUadapt) from InfluenzaA__ADM33397__NA

SEQ ID NO: 22062 - RNA, 1410 nt, Artificial Sequence; identical to SEQ ID NO: 16318
  derived and/or modified CDS sequence (AUadapt) from InfluenzaA__ADM33407__NA

SEQ ID NO: 22063 - RNA, 1410 nt, Artificial Sequence; identical to SEQ ID NO: 19170
  derived and/or modified CDS sequence (AUadapt) from InfluenzaA__ADM33417__NA

SEQ ID NO: 22064 - RNA, 1410 nt, Artificial Sequence; identical to SEQ ID NO: 16318
  derived and/or modified CDS sequence (AUadapt) from InfluenzaA__ADM33427__NA

SEQ ID NO: 22065 - RNA, 1410 nt, Artificial Sequence
  derived and/or modified CDS sequence (AUadapt) from InfluenzaA__ADM33437__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccuccgccuacaacagccgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgccugcgugaacgggucgugcuucaccgugaugaccgacggccccuccgacggccaggccagcuacaagaucuuccgcaucgagaaggggaagaucgucaaguccguggagaugaacgccccgaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccccggccgaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgcggagcugcccuucacgaucgacaaguga

SEQ ID NO: 22066 - RNA, 1410 nt, Artificial Sequence; identical to SEQ ID NO: 19494
  derived and/or modified CDS sequence (AUadapt) from InfluenzaA__ADM33443__NA

SEQ ID NO: 22067 - RNA, 1410 nt, Artificial Sequence; identical to SEQ ID NO: 16318
  derived and/or modified CDS sequence (AUadapt) from InfluenzaA__ADM52446__NA

SEQ ID NO: 22068 - RNA, 1410 nt, Artificial Sequence; identical to SEQ ID NO: 16318
  derived and/or modified CDS sequence (AUadapt) from InfluenzaA__ADM52456__NA

SEQ ID NO: 22069 - RNA, 1410 nt, Artificial Sequence; identical to SEQ ID NO: 21345
  derived and/or modified CDS sequence (AUadapt) from InfluenzaA__ADM52466__NA

SEQ ID NO: 22070 - RNA, 1410 nt, Artificial Sequence; identical to SEQ ID NO: 16318
  derived and/or modified CDS sequence (AUadapt) from InfluenzaA__ADM52486__NA

SEQ ID NO: 22071 - RNA, 1410 nt, Artificial Sequence; identical to SEQ ID NO: 16274
  derived and/or modified CDS sequence (AUadapt) from InfluenzaA__ADM52496__NA

SEQ ID NO: 22072 - RNA, 1410 nt, Artificial Sequence; identical to SEQ ID NO: 16318
  derived and/or modified CDS sequence (AUadapt) from InfluenzaA__ADM52506__NA

SEQ ID NO: 22073 - RNA, 1410 nt, Artificial Sequence; identical to SEQ ID NO: 16274
  derived and/or modified CDS sequence (AUadapt) from InfluenzaA__ADM52516__NA

SEQ ID NO: 22074 - RNA, 1410 nt, Artificial Sequence; identical to SEQ ID NO: 16274
  derived and/or modified CDS sequence (AUadapt) from InfluenzaA__ADM52527__NA

SEQ ID NO: 22075 - RNA, 1410 nt, Artificial Sequence; identical to SEQ ID NO: 20363
  derived and/or modified CDS sequence (AUadapt) from InfluenzaA__ADM52537__NA

SEQ ID NO: 22076 - RNA, 1410 nt, Artificial Sequence; identical to SEQ ID NO: 20864
  derived and/or modified CDS sequence (AUadapt) from InfluenzaA__ADM52547__NA

SEQ ID NO: 22077 - RNA, 1410 nt, Artificial Sequence; identical to SEQ ID NO: 16274
  derived and/or modified CDS sequence (AUadapt) from InfluenzaA__ADM52557__NA

SEQ ID NO: 22078 - RNA, 1410 nt, Artificial Sequence; identical to SEQ ID NO: 16274
  derived and/or modified CDS sequence (AUadapt) from InfluenzaA__ADM52567__NA

SEQ ID NO: 22079 - RNA, 1410 nt, Artificial Sequence; identical to SEQ ID NO: 16274
  derived and/or modified CDS sequence (AUadapt) from InfluenzaA__ADM52577__NA

SEQ ID NO: 22080 - RNA, 1410 nt, Artificial Sequence; identical to SEQ ID NO: 16318
  derived and/or modified CDS sequence (AUadapt) from InfluenzaA__ADM52587__NA

SEQ ID NO: 22081 - RNA, 1410 nt, Artificial Sequence; identical to SEQ ID NO: 16318
  derived and/or modified CDS sequence (AUadapt) from InfluenzaA__ADM52597__NA

SEQ ID NO: 22082 - RNA, 1410 nt, Artificial Sequence; identical to SEQ ID NO: 16274
  derived and/or modified CDS sequence (AUadapt) from InfluenzaA__ADM52607__NA

SEQ ID NO: 22083 - RNA, 1410 nt, Artificial Sequence; identical to SEQ ID NO: 16274
  derived and/or modified CDS sequence (AUadapt) from InfluenzaA__ADM52617__NA

SEQ ID NO: 22084 - RNA, 1410 nt, Artificial Sequence; identical to SEQ ID NO: 20821
  derived and/or modified CDS sequence (AUadapt) from InfluenzaA__ADM52627__NA

SEQ ID NO: 22085 - RNA, 1410 nt, Artificial Sequence; identical to SEQ ID NO: 20363
  derived and/or modified CDS sequence (AUadapt) from InfluenzaA__ADM52637__NA

SEQ ID NO: 22086 - RNA, 1410 nt, Artificial Sequence; identical to SEQ ID NO: 20363
  derived and/or modified CDS sequence (AUadapt) from InfluenzaA__ADM52647__NA

SEQ ID NO: 22087 - RNA, 1410 nt, Artificial Sequence; identical to SEQ ID NO: 16274
  derived and/or modified CDS sequence (AUadapt) from InfluenzaA__ADM52657__NA

SEQ ID NO: 22088 - RNA, 1410 nt, Artificial Sequence; identical to SEQ ID NO: 20363
  derived and/or modified CDS sequence (AUadapt) from InfluenzaA__ADM52667__NA

SEQ ID NO: 22089 - RNA, 1410 nt, Artificial Sequence; identical to SEQ ID NO: 16274
  derived and/or modified CDS sequence (AUadapt) from InfluenzaA__ADM52687__NA

SEQ ID NO: 22090 - RNA, 1410 nt, Artificial Sequence; identical to SEQ ID NO: 16274
  derived and/or modified CDS sequence (AUadapt) from InfluenzaA__ADM52697__NA

SEQ ID NO: 22091 - RNA, 1410 nt, Artificial Sequence; identical to SEQ ID NO: 20821
  derived and/or modified CDS sequence (AUadapt) from InfluenzaA__ADM52707__NA

SEQ ID NO: 22092 - RNA, 1410 nt, Artificial Sequence
  derived and/or modified CDS sequence (AUadapt) from InfluenzaA__ADM52717__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgccgucuccgugaagcugguggggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22093 - RNA, 1410 nt, Artificial Sequence
  derived and/or modified CDS sequence (AUadapt) from InfluenzaA__ADM86402__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgccuccgugaagcuggccgggaacucgucccucugcccggugagcggcugggccaucuacuccaaggacaacagcguccgcaucggcuccaagggggacguguucgugauccgggagcccuucaucagcugcucgccccuggagugccgcaccuucuuccugacccagggcgcccuccugaacgacaagcacuccaacgggaccgucaaggaccggucccccuaccgcacgcugaugagcugcccgaucggcgaggugcccucccccuacaacagccgguucgagagcguggcgugguccgccucggccugccacgacgggaucaacuggcucaccaucggcaucuccggccccgacaacggggccgucgcggugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 22094 - RNA, 1410 nt, Artificial Sequence; identical to SEQ ID NO: 16318
  derived and/or modified CDS sequence (AUadapt) from InfluenzaA__ADM86412__NA

SEQ ID NO: 22095 - RNA, 1410 nt, Artificial Sequence
  derived and/or modified CDS sequence (AUadapt) from InfluenzaA__ADM86422__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgucgccggccagagcgugguguccgucaagcuggcggggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgccagcgcgugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgccugcgugaacgggagcugcuucaccgucaugaccgacggcccguccgacggccaggcgagcuacaagaucuuccgcaucgagaaggggaagguggugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 22096 - RNA, 1410 nt, Artificial Sequence; identical to SEQ ID NO: 19994
  derived and/or modified CDS sequence (AUadapt) from InfluenzaA__ADM86432__NA

SEQ ID NO: 22097 - RNA, 1410 nt, Artificial Sequence
  derived and/or modified CDS sequence (AUadapt) from InfluenzaA__ADM86443__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgugugcgugaacgggagcugcuucaccgucaugaccgacggcccguccgacggccaggcgagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaugaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22098 - RNA, 1410 nt, Artificial Sequence; identical to SEQ ID NO: 19723
  derived and/or modified CDS sequence (AUadapt) from InfluenzaA__ADM86453__NA

SEQ ID NO: 22099 - RNA, 1350 nt, Artificial Sequence; identical to SEQ ID NO: 16388
  derived and/or modified CDS sequence (AUadapt) from InfluenzaA__ADM95377__NA

SEQ ID NO: 22100 - RNA, 1410 nt, Artificial Sequence; identical to SEQ ID NO: 16318
  derived and/or modified CDS sequence (AUadapt) from InfluenzaA__ADM95650__NA

SEQ ID NO: 22101 - RNA, 1410 nt, Artificial Sequence; identical to SEQ ID NO: 16318
  derived and/or modified CDS sequence (AUadapt) from InfluenzaA__ADM95651__NA

SEQ ID NO: 22102 - RNA, 1410 nt, Artificial Sequence
  derived and/or modified CDS sequence (AUadapt) from InfluenzaA__ADM95652__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcaacugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcucacgggccuggacugcauccgccccugcuucugggucgagcugauccggggccgccccaaggagaacaccaucuggaccuccgggagcuccaucagcuucugcggcgugaacuccgacaccgucggguggagcuggcccgacggcgccgagcucccguucacgaucgacaaguga

SEQ ID NO: 22103 - RNA, 1410 nt, Artificial Sequence
  derived and/or modified CDS sequence (AUadapt) from InfluenzaA__ADM95654__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggcacggcuucgagaugaucugggaccccaacggguggaccggcaccgacaacaacuucagcaucaagcaggacaucguggggacgaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 22104 - RNA, 1410 nt, Artificial Sequence
  derived and/or modified CDS sequence (AUadapt) from InfluenzaA__ADM95655__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccucggacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacgacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22105 - RNA, 1410 nt, Artificial Sequence; identical to SEQ ID NO: 20752
  derived and/or modified CDS sequence (AUadapt) from InfluenzaA__ADM95656__NA

SEQ ID NO: 22106 - RNA, 1410 nt, Artificial Sequence; identical to SEQ ID NO: 20317
  derived and/or modified CDS sequence (AUadapt) from InfluenzaA__ADM95658__NA

SEQ ID NO: 22107 - RNA, 1410 nt, Artificial Sequence
  derived and/or modified CDS sequence (AUadapt) from InfluenzaA__ADM95659__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggagcggcuucgagaugaucugggaccccaacggguggaccggcaccgacaacaacuucuccaucaagcaggacaucaucgggacgaacgaguggucgggcuacuccgggagcuucgugcagcacccggagcugaccggccuggacugcauccgccccugcuucuggguggagcucauccggggccgccccaaggagaacaccaucuggaccuccgggagcuccaucagcuucugcggcgucaacuccgacacggugggguggagcuggcccgacggcgccgagcugccguucaccaucgacaaguga

SEQ ID NO: 22108 - RNA, 1410 nt, Artificial Sequence; identical to SEQ ID NO: 16318
  derived and/or modified CDS sequence (AUadapt) from InfluenzaA__ADM95660__NA

SEQ ID NO: 22109 - RNA, 1410 nt, Artificial Sequence
  derived and/or modified CDS sequence (AUadapt) from InfluenzaA__ADM95661__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacucgggguccuucgugcagcacccggagcugaccggccuggacugcauccgccccugcuucugggucgagcucauccggggccgccccaaggagaacaccaucuggaccagcggguccaucaucagcuucugcggcgugaacuccgacacggucggguggagcuggcccgacggcgccgagcugccguucaccaucgacaaguga

SEQ ID NO: 22110 - RNA, 1410 nt, Artificial Sequence; identical to SEQ ID NO: 20752
  derived and/or modified CDS sequence (AUadapt) from InfluenzaA__ADM95662__NA

SEQ ID NO: 22111 - RNA, 1410 nt, Artificial Sequence
  derived and/or modified CDS sequence (AUadapt) from InfluenzaA__ADM95663__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucaacggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgaucgagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaaguccaucagcagccggaacggcuucgagaugaucugggaccccaacggguggaccggcaccgacaacaacuucuccaucaagcaggacaucgucgggacgaacgaguggucgggcuacuccgggagcuucgugcagcacccggagcugaccggccuggacugcauccgccccugcuucuggguggagcucauccggggccgccccaaggagaacaccaucuggaccuccgggagcaucaucuccuucugcggcgucaacagcgacacgguggggugguccuggcccgacggcgccgagcugccguucaccaucgacaaguga

SEQ ID NO: 22112 - RNA, 1410 nt, Artificial Sequence; identical to SEQ ID NO: 20752
  derived and/or modified CDS sequence (AUadapt) from InfluenzaA__ADM95664__NA

SEQ ID NO: 22113 - RNA, 1410 nt, Artificial Sequence; identical to SEQ ID NO: 20752
  derived and/or modified CDS sequence (AUadapt) from InfluenzaA__ADM95665__NA

SEQ ID NO: 22114 - RNA, 1410 nt, Artificial Sequence
  derived and/or modified CDS sequence (AUadapt) from InfluenzaA__ADM95666__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuucaagaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcaucuucggggacaacccgcgccccaacgacaagaccggcuccugcggccccgugagcuucaacggggccaacggcgugaagggguucuccuucaaguacggcaacggggucuggaucggccggaccaagagcaucuccagccgcaacggcuucgagaugaucugggaccccaacggguggaccggcaccgacaacaacuucucgaucaagcaggacaucguggggacgaacgagugguccggcuacagcggguccuucgugcagcacccggagcugaccggccuggacugcauccggcccugcuucugggucgagcucauccgcggccggcccaaggagaacaccaucuggaccagcggguccaucaucagcuucugcggcgugaacuccgacacggucggguggagcuggcccgacggcgccgagcugccguucaccaucgacaaguga

SEQ ID NO: 22115 - RNA, 1410 nt, Artificial Sequence; identical to SEQ ID NO: 20752
  derived and/or modified CDS sequence (AUadapt) from InfluenzaA__ADM95667__NA

SEQ ID NO: 22116 - RNA, 1410 nt, Artificial Sequence; identical to SEQ ID NO: 20752
  derived and/or modified CDS sequence (AUadapt) from InfluenzaA__ADM95668__NA

SEQ ID NO: 22117 - RNA, 1410 nt, Artificial Sequence; identical to SEQ ID NO: 16318
  derived and/or modified CDS sequence (AUadapt) from InfluenzaA__ADM95669__NA

SEQ ID NO: 22118 - RNA, 1410 nt, Artificial Sequence; identical to SEQ ID NO: 16318
  derived and/or modified CDS sequence (AUadapt) from InfluenzaA__ADM95670__NA

SEQ ID NO: 22119 - RNA, 1410 nt, Artificial Sequence
  derived and/or modified CDS sequence (AUadapt) from InfluenzaA__ADM95672__NA
augaaccccaaccagaagaucaucaccaucggcucggugugcaugaccaucgggauggccaaccugauccuccagaucggcaacaucaucuccaucuggaucagccacacgauccagcuggggaaccagaaccagaucgagaccugcaaccaguccgucaucaccuacgagaacaacaccugggugaaccagacguacgugaacaucagcaacaccaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggacgaucaaggaccggagccccuaccgcacccugauguccugcccgaucggcgagguccccagccccuacaacucccgguucgagucgguggccuggagcgcguccgccugccacgacgggaucaacuggcucaccaucggcaucagcggccccgacaacggggccguggccguccugaaguacaacggcaucaucaccgacacgaucaaguccuggcgcaacaacauccugcggacccaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucucgagccggaacggcuucgagaugaucugggaccccaacggguggaccggcacggacaacaacuucuccaucaagcaggacaucguggggaccaacgaguggagcggcuacuccgggucguucgugcagcacccggagcugaccggccuggacugcauccgccccugcuucugggucgagcucauccggggccgccccaaggagaacaccaucuggacguccgggagcuccaucagcuucugcggcgugaacuccgacaccgucggguggagcuggcccgacggcgccgagcugccguucaccaucgacaaguga

SEQ ID NO: 22120 - RNA, 1410 nt, Artificial Sequence; identical to SEQ ID NO: 16318
  derived and/or modified CDS sequence (AUadapt) from InfluenzaA__ADM95673__NA

SEQ ID NO: 22121 - RNA, 1410 nt, Artificial Sequence; identical to SEQ ID NO: 20752
  derived and/or modified CDS sequence (AUadapt) from InfluenzaA__ADM95674__NA

SEQ ID NO: 22122 - RNA, 1410 nt, Artificial Sequence; identical to SEQ ID NO: 16318
  derived and/or modified CDS sequence (AUadapt) from InfluenzaA__ADM95675__NA

SEQ ID NO: 22123 - RNA, 1410 nt, Artificial Sequence
  derived and/or modified CDS sequence (AUadapt) from InfluenzaA__ADM95677__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucaacggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggacgaacgaguggucgggcuacuccgggagcuucgugcagcacccggagcugaccggccuggacugcauccgccccugcuucugggucgagcucauccggggccgccccaaggagaacaccaucuggaccuccgggagcaucaucuccuucugcggcgugaacagcgacacggucgggugguccuggcccgacggcgccgagcugccguucaccaucgacaaguga

SEQ ID NO: 22124 - RNA, 1410 nt, Artificial Sequence
  derived and/or modified CDS sequence (AUadapt) from InfluenzaA__ADM95678__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 22125 - RNA, 1410 nt, Artificial Sequence; identical to SEQ ID NO: 22123
  derived and/or modified CDS sequence (AUadapt) from InfluenzaA__ADM95679__NA

SEQ ID NO: 22126 - RNA, 1410 nt, Artificial Sequence; identical to SEQ ID NO: 22123
  derived and/or modified CDS sequence (AUadapt) from InfluenzaA__ADM95680__NA

SEQ ID NO: 22127 - RNA, 1410 nt, Artificial Sequence; identical to SEQ ID NO: 16318
  derived and/or modified CDS sequence (AUadapt) from InfluenzaA__ADM95681__NA

SEQ ID NO: 22128 - RNA, 1410 nt, Artificial Sequence
  derived and/or modified CDS sequence (AUadapt) from InfluenzaA__ADM95682__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagaucugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacggugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaccaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22129 - RNA, 1410 nt, Artificial Sequence
  derived and/or modified CDS sequence (AUadapt) from InfluenzaA__ADM95683__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcauguccuucugcggcgugaacagcgacaccgucgggugguccuggcccgacggcgccgagcugccguucacgaucgacaaguga

SEQ ID NO: 22130 - RNA, 1410 nt, Artificial Sequence; identical to SEQ ID NO: 16318
  derived and/or modified CDS sequence (AUadapt) from InfluenzaA__ADM95684__NA

SEQ ID NO: 22131 - RNA, 1410 nt, Artificial Sequence
  derived and/or modified CDS sequence (AUadapt) from InfluenzaA__ADM95685__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggcacggcuucgagaugaucugggaccccaacggguggaccggcaccgacaacaacuucagcaucaagcaggacaucguggggacgaacgagugguccggcuacucgggguccuucgugcagcacccggagcugaccggccuggacugcauccgccccugcuucugggucgagcucauccggggccgccccaaggagaacaccguguggaccagcggguccagcaucuccuucugcggcgucaacagcgacacgguggggugguccuggcccgacggcgccgagcugccguucaccaucgacaaguga

SEQ ID NO: 22132 - RNA, 1410 nt, Artificial Sequence
  derived and/or modified CDS sequence (AUadapt) from InfluenzaA__ADM95686__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacgacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22133 - RNA, 1410 nt, Artificial Sequence; identical to SEQ ID NO: 16318
  derived and/or modified CDS sequence (AUadapt) from InfluenzaA__ADM95687__NA

SEQ ID NO: 22134 - RNA, 1410 nt, Artificial Sequence
  derived and/or modified CDS sequence (AUadapt) from InfluenzaA__ADM95688__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggacgaacgagugguccggcuacucgggguccuucgugcagcacccggagcugacccgccuggacugcauccggcccugcuucugggucgagcucauccgcggccggcccaaggagaacaccaucuggaccagcggcuccaucaucagcuucugcggggugaacuccgacacggucggcuggagcuggcccgacggggccgagcugccguucaccaucgacaaguga

SEQ ID NO: 22135 - RNA, 1410 nt, Artificial Sequence; identical to SEQ ID NO: 22132
  derived and/or modified CDS sequence (AUadapt) from InfluenzaA__ADM95689__NA

SEQ ID NO: 22136 - RNA, 1410 nt, Artificial Sequence
  derived and/or modified CDS sequence (AUadapt) from InfluenzaA__ADM95690__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucaucgggacgaacgagugguccggcuacucgggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 22137 - RNA, 1410 nt, Artificial Sequence; identical to SEQ ID NO: 16318
  derived and/or modified CDS sequence (AUadapt) from InfluenzaA__ADM95691__NA

SEQ ID NO: 22138 - RNA, 1410 nt, Artificial Sequence
  derived and/or modified CDS sequence (AUadapt) from InfluenzaA__ADM95692__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucaucaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22139 - RNA, 1410 nt, Artificial Sequence; identical to SEQ ID NO: 16318
  derived and/or modified CDS sequence (AUadapt) from InfluenzaA__ADM95693__NA

SEQ ID NO: 22140 - RNA, 1410 nt, Artificial Sequence; identical to SEQ ID NO: 16318
  derived and/or modified CDS sequence (AUadapt) from InfluenzaA__ADM95694__NA

SEQ ID NO: 22141 - RNA, 1410 nt, Artificial Sequence; identical to SEQ ID NO: 16318
  derived and/or modified CDS sequence (AUadapt) from InfluenzaA__ADM95695__NA

SEQ ID NO: 22142 - RNA, 1410 nt, Artificial Sequence; identical to SEQ ID NO: 22132
  derived and/or modified CDS sequence (AUadapt) from InfluenzaA__ADM95696__NA

SEQ ID NO: 22143 - RNA, 1410 nt, Artificial Sequence; identical to SEQ ID NO: 20752
  derived and/or modified CDS sequence (AUadapt) from InfluenzaA__ADM95697__NA

SEQ ID NO: 22144 - RNA, 1413 nt, Artificial Sequence
  derived and/or modified CDS sequence (AUadapt) from InfluenzaA__ADM95698__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacaacaccugggugaaccacaccuacgucaacaucaacaacacgaacgugguggcggaggaggacaagaccuccgucacccuggccgggaacucgucccugugcagcaucuccggcugggccaucuacaccaaggacaacucgauccggaucggcuccaagggggacguguucgugauccgcgagccguucaucagcugcucccaccucgagugccggacguucuuccugacccagggcgcccugcucaacgacaagcacucgaacgggaccgucaaggaccgcucccccuaccgggcccugaugagcugcccccugggcgaggcgcccuccccguacaacucgaaguucgagagcguggccugguccgccagcgccugccacgacgggaugggcuggcucaccaucggcaucuccgggcccgacaacggcgcgguggccguccugaaguacaacgggaucaucacgggcaccaucaagucguggaagaagcagauccugcgcacccaggaguccgagugcgugugcaugaacggcagcugcuucaccaucaugacggacgggcccuccaacaaggccgccucguacaagaucuucaagaucgagaagggcaaggugaccaaguccaucgagcucaacgcccccaacuuccacuacgaggagugcagcugcuacccggacaccgggaucgucaugugcgugugccgggacaacuggcacggcuccaaccgccccugggugucguucaaccagaaccuggacuaccagaucggguacaucugcuccggcgucuucggcgacaacccccggcccgaggacggggagggcagcugcaacccggugaccguggacggggcgaacggcgucaagggguucuccuacaaguacgacaacggcguguggaucggccgcaccaagucgaaccggcugcgcaagggguucgagaugaucugggaccccaacggcuggacgaacaccgacuccgacuucagcgugaagcaggacgucguggccaucaccgacugguccggguacucgggcagcuucgugcagcaccccgagcucacggggcuggacugcauccggcccugcuucugggucgagcuggugcgcggccagccgcgggagaacaccaccaucuggaccuccggcucguccaucagcuucugcggggucaacuccgacacggccaacuggagcuggcccgacggcgccgagcuccccuucaccaucgacaaguga

SEQ ID NO: 22145 - RNA, 1413 nt, Artificial Sequence
  derived and/or modified CDS sequence (AUadapt) from InfluenzaA__ADM95699__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacaacaccugggugaaccacaccuacgucaacaucaacaacacgaacgugguggcggaggaggacaagaccuccgucacccuggccgggaacagcucccugugcucgaucuccggcugggccaucuacaccaaggacaacagcauccggaucggcuccaagggggacguguucgugauccgcgagccguucaucucgugcucccaccucgagugccggacguucuuccugacccagggcgcccugcucaacgacaagcacagcaacgggaccgucaaggaccgcucccccuaccgggcccugaugagcugcccccugggcgaggcgcccuccccguacaacucgaaguucgagagcguggccugguccgccagcgccugccacgacgggaugggcuggcucaccaucggcaucuccgggcccgacaacggcgcgguggccguccugaaguacaacgggaucaucacgggcaccaucaagucguggaagaagcagauccugcgcacccaggaguccgagugcgugugcaugaacggcagcugcuucaccaucaugacggacgggcccuccaacaaggccgccucguacaagaucuucaagaucgagaagggcaaggugaccaaguccaucgagcucaacgcccccaacuucuacuacgaggagugcagcugcuacccggacaccgggaucgucaugugcgugugccgggacaacuggcacggcuccaaccgccccugggugagcuucaaccagaaccuggacuaccagaucggguacaucugcuccggcgucuucggcgacaacccccggcccgaggacggggagggcucgugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucucggugaagcaggacgucguggccaucaccgacugguccggguacagcggcagcuucgugcagcaccccgagcucacggggcuggacugcauccggcccugcuucugggucgagcuggugcgcggccucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 22146 - RNA, 1413 nt, Artificial Sequence
  derived and/or modified CDS sequence (AUadapt) from InfluenzaA__ADM95701__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacaacaccugggugaaccacaccuacgucaacaucaacaacacgaacgugguggcggaggaggacaagaccuccgucacccuggccgggaacucgucccugugcagcaucuccggcugggccaucuacaccaaggacaacagcauccggaucggcuccaagggggacguguucgugauccgcgagccguucaucucgugcucccaccucgagugccggacguucuuccugacccagggcgcccugcucaacgacaagcacagcaacgggaccgucaaggaccgcucccccuaccgggcccugaugucgugcccccugggcgaggcgcccuccccguacaacagcaaguucgagucgguggccugguccgccagcgccugccacgacgggaugggcuggcucaccaucggcaucuccgggcccgacaacggcgcgguggccguccugaaguacaacgggaucaucacgggcaccaucaagagcuggaagaagcagauccugcgcacccaggaguccgagugcgugugcaugaacggcucgugcuucaccaucaugacggacgggcccuccaacaaggccgccagcuacaagaucuucaagaucgagaagggcaaggugaccaaguccaucgagcucaacgcccccaacuuccacuacgaggagugcucgugcuacccggacaccgggaucgucaugugcgugugccgggacaacuggcacggcuccaaccgccccugggugagcuucaaccagaaccuggacuaccagaucggguacaucugcuccggcgucuucggcgacaacccccggcccgaggacggggagggcucgugcaacccggugaccguggacggggcgaacggcgucaagggguucuccuacaaguacgacaacggcguguggaucggccgcaccaagagcaaccggcugcgcaagggguucgagaugaucugggaccccaacggcuggacgaacaccgacuccgacuucagcgugaagcaggacgucguggccaucaccgacugguccggguacucgggcagcuucgugcagcaccccgagcucacggggcuggacugcauccggcccugcuucugggucgagcuggugcgcggccucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 22147 - RNA, 1413 nt, Artificial Sequence
  derived and/or modified CDS sequence (AUadapt) from InfluenzaA__ADM95702__NA
augaaccccaaccagaagaucaucaccaucggcucgaucuccaucgccaucgggaucaucagccugaugcuccagaucggcaacaucaucuccaucugggccucgcacuccauccagaccgggcgccagaacaacacgggcaucugcaaccagcggaucaucaccuacgagaacagcaccugggugaaccacaccuacgucaacaucaacaacacgaaggugguggcgggggaggacaagaccuccgucacccuggccggcaacagcucccugugcucgaucuccggcugggccaucuacaccaaggacaacagcauccgcaucggguccaagggcgacguguucgugauccgggagccguucaucucgugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggucgugcaacccggugaccguggacggcgcgaacggggucaagggcuucuccuacaaguacggcaacgggguguggaucggccggaccaagagcaaccgccugcggaagggguucgaggugaucugggaccccaacggcuggacgaacaccgacuccgacuucucggucaagcaggacgugguggccaucaccgacugguccggguacagcggcagcuucguccagcaccccgagcucacgggccuggacugcauccgccccugcuucuggguggagcugguccgggggcucccgcgcgagaacaccaccaucuggaccuccggcucguccaucagcuucugcggggugaacuccgacacggccaacuggagcuggcccgacggcgccgagcugcccuucaccaucgacaaguga

SEQ ID NO: 22148 - RNA, 1413 nt, Artificial Sequence
  derived and/or modified CDS sequence (AUadapt) from InfluenzaA__ADM95704__NA
augaaccccaaccagaagaucaucaccaucggcucgaucuccaucgccaucgggaucaucagccugaugcuccagaucggcaacaucguguccaucugggccucgcacuccauccagaccgggagccagaacaacacgggcaucugcaaccagcgcaucaucaccuacgagaacaacaccugggucaaccacaccuacgugaacaucaacaacacgaacguggucgcggaggaggacaagaccuccgugacccuggccgggaacucgucccugugcagcaucuccggcugggccaucuacaccaaggacaacagcauccggaucggcuccaagggggacguguucgucauccgcgagccguucaucucgugcucccaccucgagugccggacguucuuccugacccagggcgcccugcucaacgacaagcacagcaacgggaccgugaaggaccgcucccccuaccgggcccugaugucgugcccccugggcgaggcgcccuccccguacaacagcaaguucgagucgguggccugguccgccagcgccugccacgacgggaugggcuggcucaccaucggcaucuccgggcccgacaacggcgcggucgccgugcugaaguacaacgggaucaucacgggcaccaucaagagcuggaagaagcagauccugcgcacccaggaguccgagugcgugugcaugaacggcucgugcuucaccaucaugacggacgggcccuccaaccgggccgccagcuacaagaucuucaagaucgagaagggcaaggucaccaaguccaucgagcucaacgcccccaacuuccacuacgaggagugcucgugcuacccggacaccgggaucgugaugugcgugugccgcgacaacuggcacggcuccaaccggcccugggucagcuucaaccagaaccuggacuaccagaucggguacaucugcuccggcguguucggcgacaacccccgccccgaggacggggagggcucgugcaacccggugaccgucgacggggcgaacggcgugaagggguucuccuacaaguacgacaacggcguguggaucggccggaccaagagcaaccgccugcggaagggguucgagaugaucugggaccccaacggcuggacgaacaccgacuccgacuucagcgucaagcaggacgugguggccaucaccgacugguccggguacucgggcagcuucguccagcaccccgagcucacggggcuggacugcauccgccccugcuucuggguggagcugguccggggccucccgcgcgagaacaccaccaucuggaccuccggcucguccaucagcuucugcggggugaacuccgacacggccaacuggagcuggcccgacggcgccgagcugcccuucaccaucgacaaguga

SEQ ID NO: 22149 - RNA, 1413 nt, Artificial Sequence
  derived and/or modified CDS sequence (AUadapt) from InfluenzaA__ADM95705__NA
augaaccccaaccagaagaucaucaccaucggcucgaucuccaucgccaucgggaucaucagccugaugcuccagaucggcaacaucaucuccaucugggccucgcacuccauccagaccgggcgccagaacaacacgggcaucugcaaccagcggaucaucaccuacgagaacagcaccugggugaaccacaccuacgucaacaucaacaacacgaaggugguggcgggggaggacaagaccuccgucacccuggccggcaacagcucccugugcucgaucuccggcugggccaucuacaccaaggacaacagcauccgcaucggguccaagggcgacguguucgugauccgggagccguucaucucgugcucccaccucgagugccgcacguucuuccugacccagggggcccugcucaacgacaagcacagcaacggcaccgucaaggaccggucccccuaccgcgcccugaugagcugcccccugggggaggcgcccuccccguacaacucgaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacaaggccgccucguacaagaucuucaagaucgagaaggggaaggugaccaaguccaucgagcucaacgcccccaacuucuacuacgaggagugcagcugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggucgugcaacccggugaccguggacggcgcgaacggggucaagggcuucuccuacaaguacggcaacgggguguggaucggccggaccaagagcaaccgccugcggaagggguucgagaugaucugggaccccaacggcuggacgaacaccgacuccgacuucucggugaagcaggacgucguggccaucaccgacugguccggguacagcggcagcuucgugcagcaccccgagcucacgggccuggacugcauccgccccugcuucugggucgagcuggugcgggggcucccgcgcgagaacaccaccaucuggaccuccggcucguccaucagcuucugcggggucaacuccgacacggccaacuggagcuggcccgacggcgccgagcugcccuucaccaucgacaaguga

SEQ ID NO: 22150 - RNA, 1413 nt, Artificial Sequence; identical to SEQ ID NO: 22149
  derived and/or modified CDS sequence (AUadapt) from InfluenzaA__ADM95706__NA

SEQ ID NO: 22151 - RNA, 1413 nt, Artificial Sequence; identical to SEQ ID NO: 22149
  derived and/or modified CDS sequence (AUadapt) from InfluenzaA__ADM95707__NA

SEQ ID NO: 22152 - RNA, 1413 nt, Artificial Sequence; identical to SEQ ID NO: 19863
  derived and/or modified CDS sequence (AUadapt) from InfluenzaA__ADM95708__NA

SEQ ID NO: 22153 - RNA, 1410 nt, Artificial Sequence
  derived and/or modified CDS sequence (AUadapt) from InfluenzaA__ADM95710__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacaacaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagucccggcugggcuacgagaccuucaaggucaucgagggguggucgaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgacgugcuguggaccucgaacuccaucgucguguucugcggcaccagcgggacguacggcaccggguccuggccggacggcgccgacaucaaccugaugcccaucuga

SEQ ID NO: 22154 - RNA, 1410 nt, Artificial Sequence; identical to SEQ ID NO: 19001
  derived and/or modified CDS sequence (AUadapt) from InfluenzaA__ADM95711__NA

SEQ ID NO: 22155 - RNA, 1410 nt, Artificial Sequence; identical to SEQ ID NO: 19001
  derived and/or modified CDS sequence (AUadapt) from InfluenzaA__ADM95712__NA

SEQ ID NO: 22156 - RNA, 1410 nt, Artificial Sequence; identical to SEQ ID NO: 19001
  derived and/or modified CDS sequence (AUadapt) from InfluenzaA__ADM95713__NA

SEQ ID NO: 22157 - RNA, 1410 nt, Artificial Sequence
  derived and/or modified CDS sequence (AUadapt) from InfluenzaA__ADM95714__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgacgugcuguggaccuccaacagcaucgucguguucugcggcaccuccgggacguacggcaccgggagcuggccggacggcgccgacaucaaccugaugcccaucuga

SEQ ID NO: 22158 - RNA, 1410 nt, Artificial Sequence; identical to SEQ ID NO: 19001
  derived and/or modified CDS sequence (AUadapt) from InfluenzaA__ADM95715__NA

SEQ ID NO: 22159 - RNA, 1410 nt, Artificial Sequence; identical to SEQ ID NO: 22157
  derived and/or modified CDS sequence (AUadapt) from InfluenzaA__ADM95716__NA

SEQ ID NO: 22160 - RNA, 1410 nt, Artificial Sequence; identical to SEQ ID NO: 22157
  derived and/or modified CDS sequence (AUadapt) from InfluenzaA__ADM95717__NA

SEQ ID NO: 22161 - RNA, 1410 nt, Artificial Sequence; identical to SEQ ID NO: 19001
  derived and/or modified CDS sequence (AUadapt) from InfluenzaA__ADM95718__NA

SEQ ID NO: 22162 - RNA, 1410 nt, Artificial Sequence
  derived and/or modified CDS sequence (AUadapt) from InfluenzaA__ADM95719__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggagcggcuacgagaccuucaaggucaucgaggggugguccaaccccaagucgaagcugcagaucaaccgccaggugaucguggaccggggcaaccgcuccggguacagcggcaucuucucggucgaggggaaguccugcaucaaccggugcuucuacguggagcugauccgcggccggaaggaggagaccgaggugcucuggaccagcaacuccaucgucguguucugcggcaccagcgggacguacggcaccggguccuggccggacggcgccgacaucaaccugaugcccaucuga

SEQ ID NO: 22163 - RNA, 1410 nt, Artificial Sequence; identical to SEQ ID NO: 19001
  derived and/or modified CDS sequence (AUadapt) from InfluenzaA__ADM95720__NA

SEQ ID NO: 22164 - RNA, 1410 nt, Artificial Sequence; identical to SEQ ID NO: 19001
  derived and/or modified CDS sequence (AUadapt) from InfluenzaA__ADM95721__NA

SEQ ID NO: 22165 - RNA, 1410 nt, Artificial Sequence; identical to SEQ ID NO: 19001
  derived and/or modified CDS sequence (AUadapt) from InfluenzaA__ADM95723__NA

SEQ ID NO: 22166 - RNA, 1410 nt, Artificial Sequence
  derived and/or modified CDS sequence (AUadapt) from InfluenzaA__ADM95724__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 22167 - RNA, 1410 nt, Artificial Sequence
  derived and/or modified CDS sequence (AUadapt) from InfluenzaA__ADM95725__NA
augaaccccaaccagaagaucaucaccaucggcucggugucccugaccaucagcacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggaggucugcccgaagcuggccgaguaccggaacugguccaagccccagugcgacaucaccggguucgcgcccuucucgaaggacaacuccauccgccugagcgccggcggggacaucugggugacccgggagcccuacguguccugcgacccggacaagugcuaccaguucgcccucggccaggggaccacgcugaacaacguccacucgaacaacaccgugcgcgaccggacccccuaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcgucguguccuggucgaaggagauccugcgcacccaggaguccgagugcgugugcaucaacggcacgugcaccgucgugaucaccgacgggagcgccuccggcaaggccgacaccaagauccucuucaucgaggagggcaagaucgugcacacgucgacccugagcggguccgcgcagcacgucgaggagugcucgugcuacccccgguacccgggcgugcgcugcgugugccgggacaacuggaagggguccaaccgccccaucgucgacaucaacaucaaggaccacagcaucguguccucguacgugugcuccggccuggucggcgacacgccccggaagaacgacagcuccucguccagccacugccucgaccccaacaacgaggagggcgggcacggggugaagggcugggccuucgacgacgggaacgacgucuggaugggccgcaccaucuccgagaagucccggcugggcuacgagaccuucaaggugaucgagggguggucgaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgacguccuguggaccucgaacuccaucgugguguucugcggcaccagcgggacguacggcaccggguccuggcccgacggcgccgacaucaaccugaugcccaucuga

SEQ ID NO: 22168 - RNA, 1410 nt, Artificial Sequence
  derived and/or modified CDS sequence (AUadapt) from InfluenzaA__ADM95726__NA
augaaccccaaccagaagaucaucaccaucggcucggugucccugaccaucagcacgaucugcuucuucaugcagaucgccauccucaucaccgccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgacgugcuguggaccuccaacagcaucgucguguucugcggcaccuccgggaccuacggcacggggagcuggccggacggcgccgacaucaaccugaugcccaucuga

SEQ ID NO: 22169 - RNA, 1410 nt, Artificial Sequence; identical to SEQ ID NO: 19001
  derived and/or modified CDS sequence (AUadapt) from InfluenzaA__ADM95727__NA

SEQ ID NO: 22170 - RNA, 1410 nt, Artificial Sequence
  derived and/or modified CDS sequence (AUadapt) from InfluenzaA__ADM95728__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccgagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 22171 - RNA, 1410 nt, Artificial Sequence
  derived and/or modified CDS sequence (AUadapt) from InfluenzaA__ADM95729__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucgucccgcagccacugccucgaccccaacaacgaggagggcgggcacggggucaagggcugggccuucgacgacgggaacgacguguggaugggccggaccaucuccgagaagucccgccugggcuacgagaccuucaaggucaucgagggguggucgaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcaccagcgggacguacggcaccggguccuggccggacggcgccgacaucaaccugaugcccaucuga

SEQ ID NO: 22172 - RNA, 1410 nt, Artificial Sequence
  derived and/or modified CDS sequence (AUadapt) from InfluenzaA__ADM95730__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccucgaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggaccccguaccgcacccugcucaugaacgagcugggcgugcccuuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgguaccccggcguccgcugcgugugccgggacaacuggaagggguccaaccgcccgaucguggacaucaacaucaaggaccacagcaucgucuccucguacgugugcuccggccuggugggcgacacgccccggaagaacgacagcuccagcuccucgcacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 22173 - RNA, 1410 nt, Artificial Sequence
  derived and/or modified CDS sequence (AUadapt) from InfluenzaA__ADM95732__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccgguccaucgugucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagucccgccugggcuacgagaccuucaaggugaucgagggguggagcaaccacaaguccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggcccgacggcgccgacaucaaccugaugccgaucuga

SEQ ID NO: 22174 - RNA, 1410 nt, Artificial Sequence; identical to SEQ ID NO: 19001
  derived and/or modified CDS sequence (AUadapt) from InfluenzaA__ADM95733__NA

SEQ ID NO: 22175 - RNA, 1410 nt, Artificial Sequence; identical to SEQ ID NO: 19001
  derived and/or modified CDS sequence (AUadapt) from InfluenzaA__ADM95734__NA

SEQ ID NO: 22176 - RNA, 1410 nt, Artificial Sequence; identical to SEQ ID NO: 19001
  derived and/or modified CDS sequence (AUadapt) from InfluenzaA__ADM95735__NA

SEQ ID NO: 22177 - RNA, 1410 nt, Artificial Sequence; identical to SEQ ID NO: 19001
  derived and/or modified CDS sequence (AUadapt) from InfluenzaA__ADM95736__NA

SEQ ID NO: 22178 - RNA, 1410 nt, Artificial Sequence
  derived and/or modified CDS sequence (AUadapt) from InfluenzaA__ADM95737__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggccgggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgacgugcuguggaccuccaacagcaucgucguguucugcggcaccuccgggacguacggcaccgggagcuggccggacggcgccgacaucaaccugaugcccaucuga

SEQ ID NO: 22179 - RNA, 1410 nt, Artificial Sequence; identical to SEQ ID NO: 19001
  derived and/or modified CDS sequence (AUadapt) from InfluenzaA__ADM95738__NA

SEQ ID NO: 22180 - RNA, 1410 nt, Artificial Sequence; identical to SEQ ID NO: 19001
  derived and/or modified CDS sequence (AUadapt) from InfluenzaA__ADM95739__NA

SEQ ID NO: 22181 - RNA, 1410 nt, Artificial Sequence
  derived and/or modified CDS sequence (AUadapt) from InfluenzaA__ADM95740__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacgacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccaaggugcuguggaccuccaacagcaucgucguguucugcggcaccuccgggacguacggcaccgggagcuggccggacggcgccgacaucaaccugaugcccaucuga

SEQ ID NO: 22182 - RNA, 1410 nt, Artificial Sequence; identical to SEQ ID NO: 22157
  derived and/or modified CDS sequence (AUadapt) from InfluenzaA__ADM95741__NA

SEQ ID NO: 22183 - RNA, 1410 nt, Artificial Sequence; identical to SEQ ID NO: 19001
  derived and/or modified CDS sequence (AUadapt) from InfluenzaA__ADM95742__NA

SEQ ID NO: 22184 - RNA, 1410 nt, Artificial Sequence
  derived and/or modified CDS sequence (AUadapt) from InfluenzaA__ADM95743__NA
augaaccccaaccagaagaucaucaccaucggcucggugucccugaccaucagcacgaucugcuucuucaugcagaucgccauccucaucaccaccgucacccugcacuucaagcaguacgaguucaacuccucgccgaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgccguucagcaaggacaacuccauccgccugucggccggcggggacaucugggucacccgggagcccuacguguccugcgaccccgacaagugcuaccaguucgcccucggccaggggaccacgcugaacaacgugcacagcaacaacaccguccgcgaccggacccccuaccgcacccugcucaugaacgagcugggcgugccguuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgguaccccggcguccgcugcgugugccgggacaacuggaagggguccaaccgccccaucguggacaucaacaucaaggaccacagcaucgucuccucguacgugugcuccggccuggugggcgacaccccgcggaagaacgacagcuccagcuccucgcacugccucgaccccaacaacgaggagggcgggcacggggucaagggcugggccuucgacgacgggaacgacguguggaugggccgcaccaucuccgagaagucccggcugggcuacgagacguucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 22185 - RNA, 1410 nt, Artificial Sequence; identical to SEQ ID NO: 19001
  derived and/or modified CDS sequence (AUadapt) from InfluenzaA__ADM95744__NA

SEQ ID NO: 22186 - RNA, 1410 nt, Artificial Sequence; identical to SEQ ID NO: 16318
  derived and/or modified CDS sequence (AUadapt) from InfluenzaA__ADN05229__NA

SEQ ID NO: 22187 - RNA, 1413 nt, Artificial Sequence; identical to SEQ ID NO: 19863
  derived and/or modified CDS sequence (AUadapt) from InfluenzaA__ADN06292__NA

SEQ ID NO: 22188 - RNA, 1413 nt, Artificial Sequence; identical to SEQ ID NO: 21332
  derived and/or modified CDS sequence (AUadapt) from InfluenzaA__ADN06303__NA

SEQ ID NO: 22189 - RNA, 1413 nt, Artificial Sequence
  derived and/or modified CDS sequence (AUadapt) from InfluenzaA__ADN06314__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgagguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacggcgacacggccaacuggagcuggcccgacggcgccgagcugcccuucaccaucgacaaguga

SEQ ID NO: 22190 - RNA, 1413 nt, Artificial Sequence; identical to SEQ ID NO: 21332
  derived and/or modified CDS sequence (AUadapt) from InfluenzaA__ADN06325__NA

SEQ ID NO: 22191 - RNA, 1413 nt, Artificial Sequence
  derived and/or modified CDS sequence (AUadapt) from InfluenzaA__ADN06347__NA
augaaccccaaccagaagaucaucaccaucggcucgaucuccaucgccaucgggaucaucagccugaugcuccagaucggcaacaucaucuccaucugggccucgcacuccauccagaccgagagccagaacaacacggggaucugcaaccagcgcaucaucaccuacgagaacuccaccugggugaaccacaccuacgucaacaucaacaacacgaacgugguggcgggcgaggacaagaccagcgucacccuggccgggaacuccucgcugugcuccaucagcggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcgcacccaggagucggagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcucgaaccgccccuggguguccuucaaccagaaccuggacuaccagaugggguacaucugcagcggcgucuucggcgacaacccccggcccgaggacggggagggcuccugcaacccggugaacguggacggggcgaacggcgucaagggguucagcuacaaguacggcaacggcguguggaucgggcgcaccaaguccaaccggcugcgcaagggcuucgagaugaucugggaccccaacggguggacgaacaccgacucggacuucuccgugaagcaggacgucguggccaucaccgacuggagcggcuacagcggguccuucgugcagcaccccgagcucaccggccuggacugcauccggcccugcuucugggucgagcuggugcgcggccucccgcgggagaacacgaccaucuggaccucgggguccagcaucuccuucugcggcgucaacagcgacaccgccaacugguccuggcccgacggggccgagcugcccuucacgaucgacaaguga

SEQ ID NO: 22192 - RNA, 1410 nt, Artificial Sequence; identical to SEQ ID NO: 21812
  derived and/or modified CDS sequence (AUadapt) from InfluenzaA__ADN06369__NA

SEQ ID NO: 22193 - RNA, 1410 nt, Artificial Sequence; identical to SEQ ID NO: 16318
  derived and/or modified CDS sequence (AUadapt) from InfluenzaA__ADN26031__NA

SEQ ID NO: 22194 - RNA, 1410 nt, Artificial Sequence; identical to SEQ ID NO: 16318
  derived and/or modified CDS sequence (AUadapt) from InfluenzaA__ADN26032__NA

SEQ ID NO: 22195 - RNA, 1410 nt, Artificial Sequence; identical to SEQ ID NO: 16318
  derived and/or modified CDS sequence (AUadapt) from InfluenzaA__ADN26033__NA

SEQ ID NO: 22196 - RNA, 1410 nt, Artificial Sequence; identical to SEQ ID NO: 16318
  derived and/or modified CDS sequence (AUadapt) from InfluenzaA__ADN26034__NA

SEQ ID NO: 22197 - RNA, 1410 nt, Artificial Sequence; identical to SEQ ID NO: 16318
  derived and/or modified CDS sequence (AUadapt) from InfluenzaA__ADN26035__NA

SEQ ID NO: 22198 - RNA, 1410 nt, Artificial Sequence; identical to SEQ ID NO: 16318
  derived and/or modified CDS sequence (AUadapt) from InfluenzaA__ADN26036__NA

SEQ ID NO: 22199 - RNA, 1410 nt, Artificial Sequence
  derived and/or modified CDS sequence (AUadapt) from InfluenzaA__ADN26037__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaucgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22200 - RNA, 1410 nt, Artificial Sequence; identical to SEQ ID NO: 16318
  derived and/or modified CDS sequence (AUadapt) from InfluenzaA__ADN26038__NA

SEQ ID NO: 22201 - RNA, 1410 nt, Artificial Sequence; identical to SEQ ID NO: 16318
  derived and/or modified CDS sequence (AUadapt) from InfluenzaA__ADN26041__NA

SEQ ID NO: 22202 - RNA, 1410 nt, Artificial Sequence; identical to SEQ ID NO: 16318
  derived and/or modified CDS sequence (AUadapt) from InfluenzaA__ADN26042__NA

SEQ ID NO: 22203 - RNA, 1410 nt, Artificial Sequence
  derived and/or modified CDS sequence (AUadapt) from InfluenzaA__ADN26043__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccaggugggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22204 - RNA, 1410 nt, Artificial Sequence; identical to SEQ ID NO: 16318
  derived and/or modified CDS sequence (AUadapt) from InfluenzaA__ADN26044__NA

SEQ ID NO: 22205 - RNA, 1410 nt, Artificial Sequence; identical to SEQ ID NO: 16318
  derived and/or modified CDS sequence (AUadapt) from InfluenzaA__ADN26045__NA

SEQ ID NO: 22206 - RNA, 1410 nt, Artificial Sequence
  derived and/or modified CDS sequence (AUadapt) from InfluenzaA__ADN26047__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcauggucuccgugaagcugaccgggaacucgucccucugcccggugagcggcugggccaucuacuccaaggacaacagcguccgcaucggcuccaagggggacguguucgugauccgggagcccuucaucagcugcagcccccuggagugccgcaccuucuuccugacccagggcgcccuccugaacgacaagcacuccaacgggacgaucaaggaccggucccccuaccgcacccugaugucgugcccgaucggcgagguccccucccccuacaacagccgguucgagagcguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggucgugcuucaccgugaugaccgacggcccguccaacggccaggcgagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 22207 - RNA, 1410 nt, Artificial Sequence; identical to SEQ ID NO: 16318
  derived and/or modified CDS sequence (AUadapt) from InfluenzaA__ADN26048__NA

SEQ ID NO: 22208 - RNA, 1410 nt, Artificial Sequence; identical to SEQ ID NO: 16318
  derived and/or modified CDS sequence (AUadapt) from InfluenzaA__ADN26049__NA

SEQ ID NO: 22209 - RNA, 1410 nt, Artificial Sequence; identical to SEQ ID NO: 16318
  derived and/or modified CDS sequence (AUadapt) from InfluenzaA__ADN26050__NA

SEQ ID NO: 22210 - RNA, 1410 nt, Artificial Sequence; identical to SEQ ID NO: 16318
  derived and/or modified CDS sequence (AUadapt) from InfluenzaA__ADN26051__NA

SEQ ID NO: 22211 - RNA, 1410 nt, Artificial Sequence; identical to SEQ ID NO: 16318
  derived and/or modified CDS sequence (AUadapt) from InfluenzaA__ADN26052__NA

SEQ ID NO: 22212 - RNA, 1410 nt, Artificial Sequence; identical to SEQ ID NO: 16274
  derived and/or modified CDS sequence (AUadapt) from InfluenzaA__ADN26053__NA

SEQ ID NO: 22213 - RNA, 1410 nt, Artificial Sequence; identical to SEQ ID NO: 16318
  derived and/or modified CDS sequence (AUadapt) from InfluenzaA__ADN26054__NA

SEQ ID NO: 22214 - RNA, 1410 nt, Artificial Sequence; identical to SEQ ID NO: 16318
  derived and/or modified CDS sequence (AUadapt) from InfluenzaA__ADN26057__NA

SEQ ID NO: 22215 - RNA, 1410 nt, Artificial Sequence; identical to SEQ ID NO: 16318
  derived and/or modified CDS sequence (AUadapt) from InfluenzaA__ADN26058__NA

SEQ ID NO: 22216 - RNA, 1410 nt, Artificial Sequence; identical to SEQ ID NO: 16318
  derived and/or modified CDS sequence (AUadapt) from InfluenzaA__ADN26059__NA

SEQ ID NO: 22217 - RNA, 1410 nt, Artificial Sequence; identical to SEQ ID NO: 19507
  derived and/or modified CDS sequence (AUadapt) from InfluenzaA__ADN26060__NA

SEQ ID NO: 22218 - RNA, 1410 nt, Artificial Sequence; identical to SEQ ID NO: 16318
  derived and/or modified CDS sequence (AUadapt) from InfluenzaA__ADN26061__NA

SEQ ID NO: 22219 - RNA, 1410 nt, Artificial Sequence; identical to SEQ ID NO: 16318
  derived and/or modified CDS sequence (AUadapt) from InfluenzaA__ADN26063__NA

SEQ ID NO: 22220 - RNA, 1410 nt, Artificial Sequence; identical to SEQ ID NO: 16318
  derived and/or modified CDS sequence (AUadapt) from InfluenzaA__ADN26064__NA

SEQ ID NO: 22221 - RNA, 1410 nt, Artificial Sequence; identical to SEQ ID NO: 20213
  derived and/or modified CDS sequence (AUadapt) from InfluenzaA__ADN26065__NA

SEQ ID NO: 22222 - RNA, 1410 nt, Artificial Sequence; identical to SEQ ID NO: 16318
  derived and/or modified CDS sequence (AUadapt) from InfluenzaA__ADN26066__NA

SEQ ID NO: 22223 - RNA, 1410 nt, Artificial Sequence; identical to SEQ ID NO: 16318
  derived and/or modified CDS sequence (AUadapt) from InfluenzaA__ADN26067__NA

SEQ ID NO: 22224 - RNA, 1410 nt, Artificial Sequence; identical to SEQ ID NO: 16318
  derived and/or modified CDS sequence (AUadapt) from InfluenzaA__ADN26069__NA

SEQ ID NO: 22225 - RNA, 1410 nt, Artificial Sequence; identical to SEQ ID NO: 16318
  derived and/or modified CDS sequence (AUadapt) from InfluenzaA__ADN26070__NA

SEQ ID NO: 22226 - RNA, 1410 nt, Artificial Sequence; identical to SEQ ID NO: 16318
  derived and/or modified CDS sequence (AUadapt) from InfluenzaA__ADN26072__NA

SEQ ID NO: 22227 - RNA, 1410 nt, Artificial Sequence; identical to SEQ ID NO: 16318
  derived and/or modified CDS sequence (AUadapt) from InfluenzaA__ADN26073__NA

SEQ ID NO: 22228 - RNA, 1410 nt, Artificial Sequence; identical to SEQ ID NO: 16318
  derived and/or modified CDS sequence (AUadapt) from InfluenzaA__ADN26075__NA

SEQ ID NO: 22229 - RNA, 1410 nt, Artificial Sequence; identical to SEQ ID NO: 16318
  derived and/or modified CDS sequence (AUadapt) from InfluenzaA__ADN26076__NA

SEQ ID NO: 22230 - RNA, 1410 nt, Artificial Sequence; identical to SEQ ID NO: 16318
  derived and/or modified CDS sequence (AUadapt) from InfluenzaA__ADN26077__NA

SEQ ID NO: 22231 - RNA, 1410 nt, Artificial Sequence; identical to SEQ ID NO: 16318
  derived and/or modified CDS sequence (AUadapt) from InfluenzaA__ADN26078__NA

SEQ ID NO: 22232 - RNA, 1410 nt, Artificial Sequence; identical to SEQ ID NO: 16318
  derived and/or modified CDS sequence (AUadapt) from InfluenzaA__ADN26079__NA

SEQ ID NO: 22233 - RNA, 1410 nt, Artificial Sequence; identical to SEQ ID NO: 16318
  derived and/or modified CDS sequence (AUadapt) from InfluenzaA__ADN26080__NA

SEQ ID NO: 22234 - RNA, 1410 nt, Artificial Sequence; identical to SEQ ID NO: 16318
  derived and/or modified CDS sequence (AUadapt) from InfluenzaA__ADN26081__NA

SEQ ID NO: 22235 - RNA, 1410 nt, Artificial Sequence; identical to SEQ ID NO: 16318
  derived and/or modified CDS sequence (AUadapt) from InfluenzaA__ADN26082__NA

SEQ ID NO: 22236 - RNA, 1410 nt, Artificial Sequence; identical to SEQ ID NO: 16318
  derived and/or modified CDS sequence (AUadapt) from InfluenzaA__ADN26083__NA

SEQ ID NO: 22237 - RNA, 1410 nt, Artificial Sequence; identical to SEQ ID NO: 21042
  derived and/or modified CDS sequence (AUadapt) from InfluenzaA__ADN26084__NA

SEQ ID NO: 22238 - RNA, 1410 nt, Artificial Sequence; identical to SEQ ID NO: 16318
  derived and/or modified CDS sequence (AUadapt) from InfluenzaA__ADN26085__NA

SEQ ID NO: 22239 - RNA, 1410 nt, Artificial Sequence; identical to SEQ ID NO: 16318
  derived and/or modified CDS sequence (AUadapt) from InfluenzaA__ADN26086__NA

SEQ ID NO: 22240 - RNA, 1410 nt, Artificial Sequence; identical to SEQ ID NO: 16318
  derived and/or modified CDS sequence (AUadapt) from InfluenzaA__ADN26087__NA

SEQ ID NO: 22241 - RNA, 1410 nt, Artificial Sequence; identical to SEQ ID NO: 16318
  derived and/or modified CDS sequence (AUadapt) from InfluenzaA__ADN26088__NA

SEQ ID NO: 22242 - RNA, 1410 nt, Artificial Sequence; identical to SEQ ID NO: 16318
  derived and/or modified CDS sequence (AUadapt) from InfluenzaA__ADN26090__NA

SEQ ID NO: 22243 - RNA, 1410 nt, Artificial Sequence; identical to SEQ ID NO: 16318
  derived and/or modified CDS sequence (AUadapt) from InfluenzaA__ADN26091__NA

SEQ ID NO: 22244 - RNA, 1410 nt, Artificial Sequence; identical to SEQ ID NO: 16318
  derived and/or modified CDS sequence (AUadapt) from InfluenzaA__ADN26092__NA

SEQ ID NO: 22245 - RNA, 1410 nt, Artificial Sequence; identical to SEQ ID NO: 16318
  derived and/or modified CDS sequence (AUadapt) from InfluenzaA__ADN26093__NA

SEQ ID NO: 22246 - RNA, 1410 nt, Artificial Sequence
  derived and/or modified CDS sequence (AUadapt) from InfluenzaA__ADN26094__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaaggacaacaacuucucgaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 22247 - RNA, 1410 nt, Artificial Sequence; identical to SEQ ID NO: 21042
  derived and/or modified CDS sequence (AUadapt) from InfluenzaA__ADN26095__NA

SEQ ID NO: 22248 - RNA, 1410 nt, Artificial Sequence
  derived and/or modified CDS sequence (AUadapt) from InfluenzaA__ADN26096__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucaacggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacucccgguucgagagcguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagaacaucuccagccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22249 - RNA, 1410 nt, Artificial Sequence; identical to SEQ ID NO: 16318
  derived and/or modified CDS sequence (AUadapt) from InfluenzaA__ADN26097__NA

SEQ ID NO: 22250 - RNA, 1410 nt, Artificial Sequence; identical to SEQ ID NO: 16318
  derived and/or modified CDS sequence (AUadapt) from InfluenzaA__ADN26098__NA

SEQ ID NO: 22251 - RNA, 1410 nt, Artificial Sequence; identical to SEQ ID NO: 16318
  derived and/or modified CDS sequence (AUadapt) from InfluenzaA__ADN26099__NA

SEQ ID NO: 22252 - RNA, 1410 nt, Artificial Sequence; identical to SEQ ID NO: 16318
  derived and/or modified CDS sequence (AUadapt) from InfluenzaA__ADN26100__NA

SEQ ID NO: 22253 - RNA, 1410 nt, Artificial Sequence; identical to SEQ ID NO: 16318
  derived and/or modified CDS sequence (AUadapt) from InfluenzaA__ADN26101__NA

SEQ ID NO: 22254 - RNA, 1410 nt, Artificial Sequence
  derived and/or modified CDS sequence (AUadapt) from InfluenzaA__ADN26102__NA
augaaccccaaccagaagaucaucaccaucggcucggugugcaugaccaucgggauggccaaccugauccuccagaucggcaacaucaucuccaucuggaucagccaccugauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccagccugugcccggucuccggcugggccaucuacucgaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccagccccuacaacucccgguucgagagcguggccuggucggcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccaggccuccuacaagaucuucaagaucgagaaggggaagaucgucaagagcguggagaugaacgcccccaacuaccacuacgaggagugcuccugcuaccccgacucguccgagaucacgugcgugugccgcgacaacuggcacggcagcaaccggcccugggucuccuucaaccagaaccuggaguaccagaucggguacaucugcagcggcaucuucggggacaacccgcgccccaacgacaagaccggcuccugcggccccgugagcuccaacggggccaacggcgugaagggguucagcuucaaguacggcaacggggucuggaucggccggaccaaguccaucagcucgcgcaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccggcccugcuucugggucgagcugauccgcggccggcccaaggagaacuccaucuggaccagcggguccagcaucuccuucugcggcgugaacagcgacaccgucgggugguccuggcccgacggcgccgagcugccguucaccaucgacaaguga

SEQ ID NO: 22255 - RNA, 1410 nt, Artificial Sequence; identical to SEQ ID NO: 16318
  derived and/or modified CDS sequence (AUadapt) from InfluenzaA__ADN26103__NA

SEQ ID NO: 22256 - RNA, 1410 nt, Artificial Sequence; identical to SEQ ID NO: 16318
  derived and/or modified CDS sequence (AUadapt) from InfluenzaA__ADN26104__NA

SEQ ID NO: 22257 - RNA, 1410 nt, Artificial Sequence; identical to SEQ ID NO: 16318
  derived and/or modified CDS sequence (AUadapt) from InfluenzaA__ADN26105__NA

SEQ ID NO: 22258 - RNA, 1410 nt, Artificial Sequence; identical to SEQ ID NO: 16318
  derived and/or modified CDS sequence (AUadapt) from InfluenzaA__ADN26106__NA

SEQ ID NO: 22259 - RNA, 1410 nt, Artificial Sequence; identical to SEQ ID NO: 21042
  derived and/or modified CDS sequence (AUadapt) from InfluenzaA__ADN26107__NA

SEQ ID NO: 22260 - RNA, 1410 nt, Artificial Sequence; identical to SEQ ID NO: 21042
  derived and/or modified CDS sequence (AUadapt) from InfluenzaA__ADN26108__NA

SEQ ID NO: 22261 - RNA, 1410 nt, Artificial Sequence; identical to SEQ ID NO: 16318
  derived and/or modified CDS sequence (AUadapt) from InfluenzaA__ADN26109__NA

SEQ ID NO: 22262 - RNA, 1410 nt, Artificial Sequence; identical to SEQ ID NO: 20114
  derived and/or modified CDS sequence (AUadapt) from InfluenzaA__ADN26110__NA

SEQ ID NO: 22263 - RNA, 1410 nt, Artificial Sequence; identical to SEQ ID NO: 21042
  derived and/or modified CDS sequence (AUadapt) from InfluenzaA__ADN26111__NA

SEQ ID NO: 22264 - RNA, 1410 nt, Artificial Sequence; identical to SEQ ID NO: 20114
  derived and/or modified CDS sequence (AUadapt) from InfluenzaA__ADN26112__NA

SEQ ID NO: 22265 - RNA, 1410 nt, Artificial Sequence; identical to SEQ ID NO: 21042
  derived and/or modified CDS sequence (AUadapt) from InfluenzaA__ADN26113__NA

SEQ ID NO: 22266 - RNA, 1410 nt, Artificial Sequence
  derived and/or modified CDS sequence (AUadapt) from InfluenzaA__ADN26114__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucaacaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22267 - RNA, 1410 nt, Artificial Sequence; identical to SEQ ID NO: 16318
  derived and/or modified CDS sequence (AUadapt) from InfluenzaA__ADN26115__NA

SEQ ID NO: 22268 - RNA, 1410 nt, Artificial Sequence
  derived and/or modified CDS sequence (AUadapt) from InfluenzaA__ADN26116__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucaacggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacucccgguucgagagcguggccuggagcgcguccgccugccacgacgggaucaacuggcucaccaucggcaucucgggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgcgccuggacugcauccggcccugcuucugggucgagcucauccgcggccggcccaaggagaacaccaucuggaccuccggcagcuccaucagcuucugcggggugaacuccgacaccgucggcuggagcuggcccgacggggccgagcugccguucacgaucgacaaguga

SEQ ID NO: 22269 - RNA, 1410 nt, Artificial Sequence; identical to SEQ ID NO: 21042
  derived and/or modified CDS sequence (AUadapt) from InfluenzaA__ADN26117__NA

SEQ ID NO: 22270 - RNA, 1410 nt, Artificial Sequence; identical to SEQ ID NO: 21042
  derived and/or modified CDS sequence (AUadapt) from InfluenzaA__ADN26118__NA

SEQ ID NO: 22271 - RNA, 1410 nt, Artificial Sequence; identical to SEQ ID NO: 16318
  derived and/or modified CDS sequence (AUadapt) from InfluenzaA__ADN26119__NA

SEQ ID NO: 22272 - RNA, 1410 nt, Artificial Sequence; identical to SEQ ID NO: 20114
  derived and/or modified CDS sequence (AUadapt) from InfluenzaA__ADN26120__NA

SEQ ID NO: 22273 - RNA, 1410 nt, Artificial Sequence; identical to SEQ ID NO: 21042
  derived and/or modified CDS sequence (AUadapt) from InfluenzaA__ADN26121__NA

SEQ ID NO: 22274 - RNA, 1410 nt, Artificial Sequence; identical to SEQ ID NO: 16318
  derived and/or modified CDS sequence (AUadapt) from InfluenzaA__ADN26122__NA

SEQ ID NO: 22275 - RNA, 1410 nt, Artificial Sequence; identical to SEQ ID NO: 16318
  derived and/or modified CDS sequence (AUadapt) from InfluenzaA__ADN26123__NA

SEQ ID NO: 22276 - RNA, 1410 nt, Artificial Sequence; identical to SEQ ID NO: 16318
  derived and/or modified CDS sequence (AUadapt) from InfluenzaA__ADN26124__NA

SEQ ID NO: 22277 - RNA, 1410 nt, Artificial Sequence; identical to SEQ ID NO: 20114
  derived and/or modified CDS sequence (AUadapt) from InfluenzaA__ADN26125__NA

SEQ ID NO: 22278 - RNA, 1410 nt, Artificial Sequence; identical to SEQ ID NO: 20114
  derived and/or modified CDS sequence (AUadapt) from InfluenzaA__ADN26126__NA

SEQ ID NO: 22279 - RNA, 1410 nt, Artificial Sequence; identical to SEQ ID NO: 19905
  derived and/or modified CDS sequence (AUadapt) from InfluenzaA__ADN26127__NA

SEQ ID NO: 22280 - RNA, 1410 nt, Artificial Sequence; identical to SEQ ID NO: 16318
  derived and/or modified CDS sequence (AUadapt) from InfluenzaA__ADN26128__NA

SEQ ID NO: 22281 - RNA, 1410 nt, Artificial Sequence; identical to SEQ ID NO: 20114
  derived and/or modified CDS sequence (AUadapt) from InfluenzaA__ADN26129__NA

SEQ ID NO: 22282 - RNA, 1410 nt, Artificial Sequence; identical to SEQ ID NO: 21042
  derived and/or modified CDS sequence (AUadapt) from InfluenzaA__ADN26130__NA

SEQ ID NO: 22283 - RNA, 1410 nt, Artificial Sequence
  derived and/or modified CDS sequence (AUadapt) from InfluenzaA__ADN26131__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaagggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacacgaucuggaccagcggguccagcaucucccugugcggcgugaacagcgacaccgucgggugguccuggcccgacggcgccgagcugccguucaccaucgacaaguga

SEQ ID NO: 22284 - RNA, 1410 nt, Artificial Sequence; identical to SEQ ID NO: 21042
  derived and/or modified CDS sequence (AUadapt) from InfluenzaA__ADN26132__NA

SEQ ID NO: 22285 - RNA, 1410 nt, Artificial Sequence; identical to SEQ ID NO: 20114
  derived and/or modified CDS sequence (AUadapt) from InfluenzaA__ADN26134__NA

SEQ ID NO: 22286 - RNA, 1410 nt, Artificial Sequence; identical to SEQ ID NO: 16318
  derived and/or modified CDS sequence (AUadapt) from InfluenzaA__ADN26135__NA

SEQ ID NO: 22287 - RNA, 1410 nt, Artificial Sequence; identical to SEQ ID NO: 16318
  derived and/or modified CDS sequence (AUadapt) from InfluenzaA__ADN26136__NA

SEQ ID NO: 22288 - RNA, 1410 nt, Artificial Sequence; identical to SEQ ID NO: 16318
  derived and/or modified CDS sequence (AUadapt) from InfluenzaA__ADN26137__NA

SEQ ID NO: 22289 - RNA, 1410 nt, Artificial Sequence; identical to SEQ ID NO: 21042
  derived and/or modified CDS sequence (AUadapt) from InfluenzaA__ADN26138__NA

SEQ ID NO: 22290 - RNA, 1410 nt, Artificial Sequence; identical to SEQ ID NO: 20114
  derived and/or modified CDS sequence (AUadapt) from InfluenzaA__ADN26140__NA

SEQ ID NO: 22291 - RNA, 1410 nt, Artificial Sequence
  derived and/or modified CDS sequence (AUadapt) from InfluenzaA__ADN26141__NA
augaaccccaaccagaagaucaucaccaucggcucggugugcaugaccaucgggauggccaaccugauccuccagaucggcaacaucaucuccaucuggaucagccacuccauccagcuggggaaccagaaccgcaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccggaucggcuccaagggggacguguucgugauccgcgagcccuucaucagcugcagcccccuggagugccggaccuucuuccugacccagggcgcccuccugaacgacaagcacuccaacgggaccaucaaggaccgcucccccuaccggacgcugaugucgugcccgaucggcgagguccccucccccuacaacagccgcuucgagagcguggccugguccgcgagcgccugccacgacgggaucaacuggcucaccaucggcaucuccggccccgacaacggggccguggccguccugaaguacaacggcaucaucaccgacaccaucaagagcuggcggaacaacauccugcgcacgcaggaguccgagugcgcgugcgugaacgggucgugcuucaccgugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 22292 - RNA, 1410 nt, Artificial Sequence
  derived and/or modified CDS sequence (AUadapt) from InfluenzaA__ADN26142__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacaacaacuucgccgcgggccagagcgucguguccgugaagcuggccgggaacucgucccucugcccggucaacggcugggccaucuacagcaaggacaacuccauccgcaucggcagcaagggggacguguucgugauccgggagcccuucaucuccugcagcccccuggagugccgcacguucuuccugacccagggcgcccuccugaacgacaagcacuccaacgggaccaucaaggaccggucgcccuaccgcacccugauguccugcccgaucggcgagguccccagccccuacaacucccgguucgagagcguggccuggagcgcguccgccugccacgacgggaucaacuggcucacgaucggcaucucgggccccgacaacggggccguggccguccugaaguacaacggcaucaucaccgacaccaucaaguccuggcgcaacaacauccugcggacccaggagagcgagugcgcgugcgugaacggguccugcuucacggugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 22293 - RNA, 1410 nt, Artificial Sequence; identical to SEQ ID NO: 16318
  derived and/or modified CDS sequence (AUadapt) from InfluenzaA__ADN26143__NA

SEQ ID NO: 22294 - RNA, 1410 nt, Artificial Sequence; identical to SEQ ID NO: 21042
  derived and/or modified CDS sequence (AUadapt) from InfluenzaA__ADN26144__NA

SEQ ID NO: 22295 - RNA, 1410 nt, Artificial Sequence; identical to SEQ ID NO: 21042
  derived and/or modified CDS sequence (AUadapt) from InfluenzaA__ADN26145__NA

SEQ ID NO: 22296 - RNA, 1410 nt, Artificial Sequence; identical to SEQ ID NO: 16318
  derived and/or modified CDS sequence (AUadapt) from InfluenzaA__ADN26146__NA

SEQ ID NO: 22297 - RNA, 1410 nt, Artificial Sequence; identical to SEQ ID NO: 21042
  derived and/or modified CDS sequence (AUadapt) from InfluenzaA__ADN26147__NA

SEQ ID NO: 22298 - RNA, 1410 nt, Artificial Sequence; identical to SEQ ID NO: 16318
  derived and/or modified CDS sequence (AUadapt) from InfluenzaA__ADN26148__NA

SEQ ID NO: 22299 - RNA, 1410 nt, Artificial Sequence; identical to SEQ ID NO: 21042
  derived and/or modified CDS sequence (AUadapt) from InfluenzaA__ADN26149__NA

SEQ ID NO: 22300 - RNA, 1410 nt, Artificial Sequence
  derived and/or modified CDS sequence (AUadapt) from InfluenzaA__ADN26150__NA
augaaccccaaccagaagaucaucaccaucggcucggugugcaugaccaucgggauggccucccugauccuccagaucggcaacaucaucagcaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22301 - RNA, 1410 nt, Artificial Sequence; identical to SEQ ID NO: 20114
  derived and/or modified CDS sequence (AUadapt) from InfluenzaA__ADN26151__NA

SEQ ID NO: 22302 - RNA, 1410 nt, Artificial Sequence
  derived and/or modified CDS sequence (AUadapt) from InfluenzaA__ADN26152__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccaugaagcuggccgggaacucgucccucugcccggugaacggcugggccaucuacagcaaggacaacuccauccgcaucggcagcaagggggacgucuucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacucccgguucgagagcgucgccuggagcgcguccgccugccacgacgggaucaacuggcucaccaucggcaucucgggccccgacaacggggccguggccgugcugaaguacaacggcaucaucaccgacaccaucaaguccuggcgcaacaacauccugcggacgcaggagagcgagugcgcgugcgucaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggccgcaccaaguccaucagcagccggaacggcuucgagaugaucugggaccccaacggguggacccgcaccgacaacaacuucuccaucaagcaggacaucgucggcaucaacgaguggagcggguacuccggcucguucgugcagcacccggagcugacggggcuggacugcauccggcccugcuucuggguggagcucauccgcggccggcccaaggagaacaccaucuggaccuccggcagcuccaucagcuucugcggggucaacuccgacaccgugggcuggagcuggcccgacggggccgagcugccguucacgaucgacaaguga

SEQ ID NO: 22303 - RNA, 1410 nt, Artificial Sequence; identical to SEQ ID NO: 21042
  derived and/or modified CDS sequence (AUadapt) from InfluenzaA__ADN26153__NA

SEQ ID NO: 22304 - RNA, 1410 nt, Artificial Sequence; identical to SEQ ID NO: 19723
  derived and/or modified CDS sequence (AUadapt) from InfluenzaA__ADN26154__NA

SEQ ID NO: 22305 - RNA, 1410 nt, Artificial Sequence; identical to SEQ ID NO: 16318
  derived and/or modified CDS sequence (AUadapt) from InfluenzaA__ADN26155__NA

SEQ ID NO: 22306 - RNA, 1410 nt, Artificial Sequence; identical to SEQ ID NO: 20114
  derived and/or modified CDS sequence (AUadapt) from InfluenzaA__ADN26157__NA

SEQ ID NO: 22307 - RNA, 1410 nt, Artificial Sequence; identical to SEQ ID NO: 16318
  derived and/or modified CDS sequence (AUadapt) from InfluenzaA__ADN26159__NA

SEQ ID NO: 22308 - RNA, 1410 nt, Artificial Sequence; identical to SEQ ID NO: 16318
  derived and/or modified CDS sequence (AUadapt) from InfluenzaA__ADN26161__NA

SEQ ID NO: 22309 - RNA, 1410 nt, Artificial Sequence
  derived and/or modified CDS sequence (AUadapt) from InfluenzaA__ADN26162__NA
augaaccccaaccagaagaucaucaccaucucguccgugugcaugaccgucggcauggccaaccugauccuccagaucgggaacaucaucagcaucuggaucucccacagcauccagcugggcaaccagaaccagaucgagacgugcaaccaguccgugaucaccuacgagaacaacaccugggugaaccagaccuacgucaacaucagcaacacgaacuucgccgcggggcaguccguggugucggucaagcuggccggcaacuccagccucugcccgguguccgggugggccaucuacagcaaggacaacuccauccgcaucggcagcaagggcgacguguucgucauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacagccgguucgaguccguggccuggagcgcguccgccugccacgacggcaucaacuggcucaccaucgggaucagcggccccgacaacggcgccgucgccgugcugaaguacaacgggaucaucaccgacaccaucaaguccuggcgcaacaacauccugcggacgcaggagucggagugcgcgugcgugaacggcuccugcuucaccgucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcucggggaucuucggcgacaacccgcggcccaacgacaagaccggguccugcggccccgugagcuccaacggcgccaacggggucaagggcuucagcuucaaguacgggaacggcguguggaucgggcgcaccaagagcaucuccagccggaacggcuucgagaugaucugggaccccaacggcuggaccgggaccgacaacaacuucuccaucaagcaggacaucgugggcaucaacgaguggucgggguacuccggcagcuucguccagcacccggagcugacggggcuggacugcauccgccccugcuucuggguggagcucauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 22310 - RNA, 1410 nt, Artificial Sequence
  derived and/or modified CDS sequence (AUadapt) from InfluenzaA__ADN26163__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucaucaucgacaaguga

SEQ ID NO: 22311 - RNA, 1410 nt, Artificial Sequence
  derived and/or modified CDS sequence (AUadapt) from InfluenzaA__ADN26164__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugccucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacgacuucucgaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22312 - RNA, 1410 nt, Artificial Sequence; identical to SEQ ID NO: 21097
  derived and/or modified CDS sequence (AUadapt) from InfluenzaA__ADN26168__NA

SEQ ID NO: 22313 - RNA, 1410 nt, Artificial Sequence; identical to SEQ ID NO: 20363
  derived and/or modified CDS sequence (AUadapt) from InfluenzaA__ADN26178__NA

SEQ ID NO: 22314 - RNA, 1410 nt, Artificial Sequence; identical to SEQ ID NO: 16318
  derived and/or modified CDS sequence (AUadapt) from InfluenzaA__ADN26868__NA

SEQ ID NO: 22315 - RNA, 1410 nt, Artificial Sequence; identical to SEQ ID NO: 16318
  derived and/or modified CDS sequence (AUadapt) from InfluenzaA__ADN26869__NA

SEQ ID NO: 22316 - RNA, 1410 nt, Artificial Sequence; identical to SEQ ID NO: 16318
  derived and/or modified CDS sequence (AUadapt) from InfluenzaA__ADN26870__NA

SEQ ID NO: 22317 - RNA, 1410 nt, Artificial Sequence
  derived and/or modified CDS sequence (AUadapt) from InfluenzaA__ADN26871__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacguacaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22318 - RNA, 1410 nt, Artificial Sequence
  derived and/or modified CDS sequence (AUadapt) from InfluenzaA__ADN26872__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccugagcgucguguccgugaagcucgccgggaacagcucccugugcccggucucgggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugagcugcccgaucggcgagguccccucccccuacaacagccgguucgagucgguggccugguccgcgagcgccugccacgacgggaucuccuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22319 - RNA, 1410 nt, Artificial Sequence; identical to SEQ ID NO: 16318
  derived and/or modified CDS sequence (AUadapt) from InfluenzaA__ADN26873__NA

SEQ ID NO: 22320 - RNA, 1410 nt, Artificial Sequence; identical to SEQ ID NO: 16318
  derived and/or modified CDS sequence (AUadapt) from InfluenzaA__ADN26874__NA

SEQ ID NO: 22321 - RNA, 1410 nt, Artificial Sequence; identical to SEQ ID NO: 16318
  derived and/or modified CDS sequence (AUadapt) from InfluenzaA__ADN26875__NA

SEQ ID NO: 22322 - RNA, 1410 nt, Artificial Sequence; identical to SEQ ID NO: 16318
  derived and/or modified CDS sequence (AUadapt) from InfluenzaA__ADN26876__NA

SEQ ID NO: 22323 - RNA, 1410 nt, Artificial Sequence; identical to SEQ ID NO: 16318
  derived and/or modified CDS sequence (AUadapt) from InfluenzaA__ADN26877__NA

SEQ ID NO: 22324 - RNA, 1410 nt, Artificial Sequence; identical to SEQ ID NO: 16318
  derived and/or modified CDS sequence (AUadapt) from InfluenzaA__ADN26878__NA

SEQ ID NO: 22325 - RNA, 1410 nt, Artificial Sequence; identical to SEQ ID NO: 20277
  derived and/or modified CDS sequence (AUadapt) from InfluenzaA__ADN26879__NA

SEQ ID NO: 22326 - RNA, 1410 nt, Artificial Sequence; identical to SEQ ID NO: 16318
  derived and/or modified CDS sequence (AUadapt) from InfluenzaA__ADN26880__NA

SEQ ID NO: 22327 - RNA, 1410 nt, Artificial Sequence; identical to SEQ ID NO: 16318
  derived and/or modified CDS sequence (AUadapt) from InfluenzaA__ADN26881__NA

SEQ ID NO: 22328 - RNA, 1410 nt, Artificial Sequence; identical to SEQ ID NO: 16318
  derived and/or modified CDS sequence (AUadapt) from InfluenzaA__ADN26882__NA

SEQ ID NO: 22329 - RNA, 1410 nt, Artificial Sequence; identical to SEQ ID NO: 16318
  derived and/or modified CDS sequence (AUadapt) from InfluenzaA__ADN26883__NA

SEQ ID NO: 22330 - RNA, 1413 nt, Artificial Sequence
  derived and/or modified CDS sequence (AUadapt) from InfluenzaA__ADN89064__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgccggggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccgccccugcuucugggucgagcuggugcgggggcucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 22331 - RNA, 1413 nt, Artificial Sequence; identical to SEQ ID NO: 19863
  derived and/or modified CDS sequence (AUadapt) from InfluenzaA__ADN89075__NA

SEQ ID NO: 22332 - RNA, 1413 nt, Artificial Sequence
  derived and/or modified CDS sequence (AUadapt) from InfluenzaA__ADN89086__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaagaccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugacgguggacggcgccaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggcgaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22333 - RNA, 1413 nt, Artificial Sequence; identical to SEQ ID NO: 19863
  derived and/or modified CDS sequence (AUadapt) from InfluenzaA__ADN89097__NA

SEQ ID NO: 22334 - RNA, 1413 nt, Artificial Sequence
  derived and/or modified CDS sequence (AUadapt) from InfluenzaA__ADN89108__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacagcgacuucuccgugaagcaggacgucgugucgaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 22335 - RNA, 1413 nt, Artificial Sequence
  derived and/or modified CDS sequence (AUadapt) from InfluenzaA__ADN89119__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcacccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22336 - RNA, 1413 nt, Artificial Sequence
  derived and/or modified CDS sequence (AUadapt) from InfluenzaA__ADN89130__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaacuucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacggcgacacggccaacuggagcuggcccgacggcgccgagcugcccuucaccaucgacaaguga

SEQ ID NO: 22337 - RNA, 1413 nt, Artificial Sequence; identical to SEQ ID NO: 22334
  derived and/or modified CDS sequence (AUadapt) from InfluenzaA__ADN89141__NA

SEQ ID NO: 22338 - RNA, 1413 nt, Artificial Sequence
  derived and/or modified CDS sequence (AUadapt) from InfluenzaA__ADN89152__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccaucgacggcgcgaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 22339 - RNA, 1413 nt, Artificial Sequence
  derived and/or modified CDS sequence (AUadapt) from InfluenzaA__ADN89163__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaaccagcggaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccgcaucgggucgaagggcgacguguucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccucgccguacaacagcaaguucgaguccgucgccuggagcgccuccgcgugccacgacggcaugggcuggcucaccaucgggaucucgggccccgacaacggggccguggccgugcugaaguacaacggcaucaucacgggcaccaucaaguccuggaagaagcagauccugcggacccaggagagcgagugcgucugcaugaacggguccugcuucaccaucaugacggacggccccucgaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgcgacaacuggcacgggagcaaccggcccuggguguccuucaaccagaaccuggacuaccagaucggcuacaucugcucgggcguguucggggacaacccccgccccgaggacggcgagggguccugcaacccggucaccguggacggcgccaacggggugaagggcuucagcuacaaguacggcaacggggucuggaucggccggacgaaguccaaccgccugcggaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccgccccugcuucuggguggagcugguccgggggcucccgcgcgagaacaccaccaucuggaccucgggcuccagcaucuccuucugcggggugaacagcgacacggccaacugguccuggcccgacggcgccgagcugcccuucaccaucgacaaguga

SEQ ID NO: 22340 - RNA, 1413 nt, Artificial Sequence; identical to SEQ ID NO: 21332
  derived and/or modified CDS sequence (AUadapt) from InfluenzaA__ADN89174__NA

SEQ ID NO: 22341 - RNA, 1413 nt, Artificial Sequence; identical to SEQ ID NO: 22334
  derived and/or modified CDS sequence (AUadapt) from InfluenzaA__ADN89185__NA

SEQ ID NO: 22342 - RNA, 1413 nt, Artificial Sequence
  derived and/or modified CDS sequence (AUadapt) from InfluenzaA__ADN89196__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaugggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucgcucaagcaggacguggucgccaucaccgacuggagcggguacuccggcagcuucgugcagcaccccgagcugacgggccuggacugcauccggcccugcuucuggguggagcucguccgcgggcugccgcgggagaacaccaccaucuggaccuccggcucguccaucagcuucugcggggugaacuccgacacggccaacuggagcuggcccgacggcgccgagcugcccuucaccaucgacaaguga

SEQ ID NO: 22343 - RNA, 1413 nt, Artificial Sequence; identical to SEQ ID NO: 22342
  derived and/or modified CDS sequence (AUadapt) from InfluenzaA__ADN89207__NA

SEQ ID NO: 22344 - RNA, 1413 nt, Artificial Sequence
  derived and/or modified CDS sequence (AUadapt) from InfluenzaA__ADN89218__NA
augaaccccaaccagaagaucaucaccaucggcucgaucuccaucgccaucgggaucaucagccugaugcuccagaucggcaacaucaucuccaucugggccucgcacuccauccagccggggagccagaacaacaccggcaucugcaaccagcgcaucaucacguacgagaacuccaccugggugaaccacaccuacgucaacaucaacaacaccaacgugguggcgggggaggacaagacgagcgucacccuggccggcaacuccucgcugugcuccaucagcggcugggccaucuacaccaaggacaacuccauccggaucgggucgaagggcgacguguucgugauccgcgagcccuucaucuccugcagccaccucgagugccggaccuucuuccugacgcagggggcccugcucaacgacaagcacuccaacggcaccgucaaggaccgcagccccuaccgggcccugauguccugcccccugggggaggcgccgucgcccuacaacagcaaguucgaguccguggccuggagcgccuccgccugccacgacggcaugggcuggcucaccaucgggaucucgggccccgacaacggggcgguggccguccugaaguacaacggcaucaucaccggcacgaucaaguccuggaagaagcagauccugcgcacccaggagagcgagugcgugugcaugaacggguccugcuucaccaucaugaccgacggccccucgaacaaggccgccuccuacaagaucuucaagaucgagaaggggaaggugaccaagagcaucgagcucaacgccccgaacuucuacuacgaggagugcuccugcuaccccgacacgggcaucgucaugugcgugugccgggacaacuggcacgggagcaaccgccccuggguguccuucaaccagaaccuggacuaccagaucggcuacaucugcucgggcgucuucggggacaacccccggccggaggacggcgagggguccugcaaccccgugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacucggacuucuccgugaagcaggacgucguggccaucaccgacuggagcggguacagcggcuccuucgugcagcaccccgagcucaccggccuggacugcauccggccgugcuucugggucgagcuggugcgcgggcucccccgggagaacacgaccaucuggaccucgggcuccagcaucuccuucugcggggucaacggcgacaccgccaacuggagcuggcccgacggcgccgagcugcccuucacgaucgacaaguga

SEQ ID NO: 22345 - RNA, 1413 nt, Artificial Sequence
  derived and/or modified CDS sequence (AUadapt) from InfluenzaA__ADN89229__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaccacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22346 - RNA, 1413 nt, Artificial Sequence
  derived and/or modified CDS sequence (AUadapt) from InfluenzaA__ADN89240__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacggcgacacggccaacuggagcuggcccgacggcgccgagcugcccuucaccaucgacaaguga

SEQ ID NO: 22347 - RNA, 1413 nt, Artificial Sequence; identical to SEQ ID NO: 19863
  derived and/or modified CDS sequence (AUadapt) from InfluenzaA__ADN89251__NA

SEQ ID NO: 22348 - RNA, 1413 nt, Artificial Sequence; identical to SEQ ID NO: 19863
  derived and/or modified CDS sequence (AUadapt) from InfluenzaA__ADN89262__NA

SEQ ID NO: 22349 - RNA, 1413 nt, Artificial Sequence; identical to SEQ ID NO: 19863
  derived and/or modified CDS sequence (AUadapt) from InfluenzaA__ADN89273__NA

SEQ ID NO: 22350 - RNA, 1413 nt, Artificial Sequence; identical to SEQ ID NO: 19863
  derived and/or modified CDS sequence (AUadapt) from InfluenzaA__ADN89284__NA

SEQ ID NO: 22351 - RNA, 1413 nt, Artificial Sequence; identical to SEQ ID NO: 19863
  derived and/or modified CDS sequence (AUadapt) from InfluenzaA__ADN89295__NA

SEQ ID NO: 22352 - RNA, 1413 nt, Artificial Sequence; identical to SEQ ID NO: 19863
  derived and/or modified CDS sequence (AUadapt) from InfluenzaA__ADN89306__NA

SEQ ID NO: 22353 - RNA, 1413 nt, Artificial Sequence
  derived and/or modified CDS sequence (AUadapt) from InfluenzaA__ADN89317__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaaccagcggaucaucaccuacgagaacuccaccugggugaaccacaccuacgucaacaucaacagcacgaacgugguggcgggggaggacaagaccuccgucacccuggccggcaacucgucccugugcagcaucuccggcugggccaucuacaccaaggacaacagcauccgcaucggguccaagggcgacguguucgugauccgggagccguucaucucgugcucccaccucgagugccgcacguucuuccugacccagggggcccugcucaacgacaagcacagcaacggcaccgucaaggaccggucccccuaccgcgcccugaugagcugcccccugggggaggcgcccucgccguacaacuccaaguucgagagcguggccugguccgccagcgccugccacgacggcaugggcuggcucaccaucgggaucuccggccccgacaacggggcgguggccguccugaaguacaacggcaucaucacgggcaccaucaagucguggaagaagcagauccugcggacccaggaguccgagugcgugugcaugaacgggagcugcuucaccaucaugacggacggccccuccaacaaggccgccagcuacaagaucuucaagaucgagaaggggaaggugaccaaguccaucgagcucaacgcccccaacuucuacuacgaggagugcucgugcuacccggacaccggcaucgucaugugcgugugccgcgacaacuggcacggguccaaccggcccugggugagcuucaaccagaaccuggacuaccagaucggcuacaucugcuccggcgucuucggggacaacccccgccccgaggacggcgaggggagcugcaacccggugaccguggacggcgcgaacggggucaagggcuucuccuacaaguacggcaacgggguguggaucggccggaccaagucgaaccgccugcggaagggguucgagaugaucugggaccccaacggcuggacgaacaccgacuccgacuucagcgugaagcaggacgucguggccaucaccgacuggagcggguacuccggcucguucgugcagcaccccgagcucacgggccuggacugcauccgccccugcuucugggucgagcuggugcgggggcucccgcgcgagaacaccaccaucuggaccuccggcagcuccaucagcuucugcggggucaacggcgacacggccaacugguccuggcccgacggcgccgagcugcccuucaccaucgacaaguga

SEQ ID NO: 22354 - RNA, 1413 nt, Artificial Sequence
  derived and/or modified CDS sequence (AUadapt) from InfluenzaA__ADN89328__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucugggccuccggcucguccaucagcuucugcggggucaacuccgacaccgccaacuggagcuggcccgacggcgccgagcugcccuucacgaucgacaaguga

SEQ ID NO: 22355 - RNA, 1413 nt, Artificial Sequence; identical to SEQ ID NO: 22339
  derived and/or modified CDS sequence (AUadapt) from InfluenzaA__ADN89339__NA

SEQ ID NO: 22356 - RNA, 1413 nt, Artificial Sequence; identical to SEQ ID NO: 22345
  derived and/or modified CDS sequence (AUadapt) from InfluenzaA__ADN89350__NA

SEQ ID NO: 22357 - RNA, 1413 nt, Artificial Sequence
  derived and/or modified CDS sequence (AUadapt) from InfluenzaA__ADN89361__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucaucauccgcgagccguucaucagcugcucccaccucgagugccggacguucuuccugacccagggggcccugcucaacgacaagcacucgaacggcaccgugaaggaccgcucccccuaccgggcccugaugagcugcccccugggggaggcgcccagcccguacaacuccaaguucgagucggucgccugguccgccagcgccugccacgacggcaugggcuggcucaccaucgggaucuccggccccgacaacggggcgguggccgugcugaaguacaacggcaucaucacgggcaccaucaagagcuggaagaagcagauccugcgcacccaggaguccgagugcgucugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgugaugugcgucugccgggacaacuggcacggguccaaccgccccugggugucguucaaccagaaccuggacuaccagaucggcuacaucugcuccggcguguucggggacaacccccggcccgaggacggcgaggggagcugcaacccggucaccguggacggcgcgaacggggugaagggcuucuccuacaaguacggcaacggggucuggaucggccgcaccaagagcaaccggcugcgcaagggguucgagaugaucugggaccccaacggcuggacgaacaccgacuccgacuucucggugaagcaggacguggucgccaucaccgacuggagcggguacuccggcagcuucgugcagcaccccgagcucacgggccuggacugcauccggcccugcuucuggguggagcugguccgcgggcucccgcgggagaacaccaccaucuggaccuccggcucguccaucagcuucugcggggugaacuccgacacggccaacuggagcuggcccgacggcgccgagcugcccuucaccaucgacaaguga

SEQ ID NO: 22358 - RNA, 1413 nt, Artificial Sequence
  derived and/or modified CDS sequence (AUadapt) from InfluenzaA__ADN89372__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacaucguggcgggggaggacaagaccagcgugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccgaggacggcgagggguccugcaacccggucaccgugaacggcgcggacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 22359 - RNA, 1413 nt, Artificial Sequence; identical to SEQ ID NO: 22334
  derived and/or modified CDS sequence (AUadapt) from InfluenzaA__ADN89383__NA

SEQ ID NO: 22360 - RNA, 1413 nt, Artificial Sequence
  derived and/or modified CDS sequence (AUadapt) from InfluenzaA__ADN89405__NA
augaaccccaaccagaagaucaucaccaucggcucgaucuccaucgccaucgggaucaucagccugaugcuccagaucggcuccaucaucucgaucugggccucccacagcauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacucgucccugugcagcaccuccggcugggccaucuacacgaaggacaacagcauccggaucggguccaagggcgacguguucgugauccgcgagccguucaucucgugcucccaccucgagugccggaccuucuuccugacccagggggcccugcucaacgacaagcacagcaacggcaccgucaaggaccgcucccccuaccgggcccugaugucgugcccccugggggaggcgcccagcccguacaacuccaaguucgagagcguggccugguccgccucggccugccacgacggcaugggcuggcucacgaucgggaucuccggccccgacaacggggcgguggccguccugaaguacaacggcaucaucaccggcaccaucaagagcuggaagaagcagauccugcgcacccaggaguccgagugcgugugcaugaacgggagcugcuucacgaucaugaccgacggccccuccaacaaggccgccucguacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugacgguggacggcgcgaacggggucaagggcuucuccuacaaguacggcaacgggguguggaucggccgcaccaagagcaaccggcugcgcaagggguucgagaugaucugggaccccaacggcuggaccaacaccgacuccgacuucucggugaagcaggacgucguggccaucacggacuggagcggguacuccggcagcuucgugcagcaccccgagcucaccggccuggacugcauccggcccugcuucugggucgagcuggugcgcgggcucccgcgggagaacaccaccaucuggacguccggcucguccaucagcuucugcggggucaacuccgacaccgccaacuggagcuggcccgacggcgccgagcugcccuucaccaucgacaaguga

SEQ ID NO: 22361 - RNA, 1413 nt, Artificial Sequence
  derived and/or modified CDS sequence (AUadapt) from InfluenzaA__ADN89416__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccucggucacccuggccggcaacuccagccugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagucgaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcguccugggggacaacccccggcccgaggacggcgagggguccugcaacccggugaccguggacggcgcgaacggggucaagggcuucagcuacaaguacggcaacgggguguggaucggccgcacgaaguccaaccggcuccgcaagggguucgagaugaucugggaccccaacggcuggaccaacaccgacagcgacuucuccgugaagcaggacgucguggccaucaccgacuggucgggguacagcggcuccuucgugcagcaccccgagcugacgggccuggacugcauccggcccugcuucugggucgagcucgugcgcgggcugccgcgggagaacaccaccaucuggaccucgggcuccagcaucuccuucugcggggucaacggcgacacggccaacuggagcuggcccgacggcgccgagcugcccuucaccaucgacaaguga

SEQ ID NO: 22362 - RNA, 1413 nt, Artificial Sequence
  derived and/or modified CDS sequence (AUadapt) from InfluenzaA__ADN89427__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucgacuccgacgccgccgacuggagcuggcccgacggcgccgagcugcccuucacgaucgacaaguga

SEQ ID NO: 22363 - RNA, 1413 nt, Artificial Sequence; identical to SEQ ID NO: 19863
  derived and/or modified CDS sequence (AUadapt) from InfluenzaA__ADN89438__NA

SEQ ID NO: 22364 - RNA, 1413 nt, Artificial Sequence
  derived and/or modified CDS sequence (AUadapt) from InfluenzaA__ADN89449__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagccgagcgucacccuggccggcaacuccucgcugugcuccaucagcggcugggccaucuacaccaaggacaacuccauccggaucgggagcaagggcgacguguucgugauccgcgagcccuucaucuccugcucgcaccucgagugccggaccuucuuccugacgcagggggcccugcucaacgacaagcacuccaacggcaccgucaaggaccgcagccccuaccgggcccugauguccugcccccugggggaggcgccgagccccuacaacucgaaguucgaguccguggccuggagcgccuccgccugccacgacggcaugggcuggcucaccaucgggaucagcggccccgacaacggggcgguggccguccugaaguacaacggcaucaucaccggcacgaucaaguccuggaagaagcagauccugcgcacccaggagucggagugcgugugcaugaacggguccugcuucaccaucaugaccgacggccccagcaacaaggccgccuccuacaagaucuucaagaucgagaaggggaaggugaccaagagcaucgagcucaacgccccgaacuucuacuacgaggagugcuccugcuaccccgacacgggcaucgucaugugcgugugccgggacaacuggcacgggucgaaccgccccuggguguccuucaaccagaaccuggacuaccagaucggcuacaucugcagcggcgucuucggggacaacccccggccggaggacggcgagggguccugcaaccccgugaccguggacggcgcgaacggggucaagggcuucagcuacaaguacggcaacgggguguggaucggccgcaccaaguccaaccggcugcgcaagggguucgagaugaucugggaccccaacggcuggacgaacaccgacucggacuucuccgugaagcaggacgucguggccaucaccgacuggagcggguacagcggcuccuucgugcagcaccccgagcucaccggccuggacugcauccggccgugcuucugggucgagcuggugcgcgggcucccccgggagaacacgaccaucuggaccucgggcuccagcaucuccuucugcggggucaacagcgacaccgccaacugguccuggcccgacggcgccgagcugcccuucacgaucgacaaguga

SEQ ID NO: 22365 - RNA, 1413 nt, Artificial Sequence; identical to SEQ ID NO: 21332
  derived and/or modified CDS sequence (AUadapt) from InfluenzaA__ADN89460__NA

SEQ ID NO: 22366 - RNA, 1413 nt, Artificial Sequence; identical to SEQ ID NO: 19863
  derived and/or modified CDS sequence (AUadapt) from InfluenzaA__ADN89482__NA

SEQ ID NO: 22367 - RNA, 1413 nt, Artificial Sequence
  derived and/or modified CDS sequence (AUadapt) from InfluenzaA__ADN89493__NA
augaaccccaaccagaagaucaucaccaucggcucgaucuccaucgccaucgggaucaucagccugaugcuccagaucggcaacaucaucuccaucugggccucgcacuccauccagaccgagagccagaacaacacggggaucugcaaccagcgcaucaucaccuacgagaacuccaccugggugaaccacaccuacgucaacaucaacaacacgaacgugguggcgggcgaggacaagaccagcgucacccuggccgggaacuccucgcugugcuccaucagcggcugggccaucuacaccaaggacaacuccauccggaucggcagcaagggggacguguucgugauccgcgagccguucaucuccugcucgcaccucgagugccggacguucuuccugacccagggcgcccugcucaacgacaagcacuccaacgggaccgucaaggaccgcagccccuaccgggcccugauguccugcccccugggcgaggcgcccagcccguacaacucgaaguucgaguccguggccuggagcgccuccgccugccacgacgggaugggcuggcucaccaucggcaucagcgggcccgacaacggcgcgguggccguccugaaguacaacgggaucaucacgggcaccaucaaguccuggaagaagcagauccugcgcacccaggagucggagugcgugugcaugaacggcuccugcuucaccaucaugacggacgggcccagcaacaaggccgccuccuacaagaucuucaagaucgagaagggcaaggugaccaagagcaucgagcucaacgcccccaacuucuacuacgaggagugcuccugcuacccggacaccgggaucgucaugugcgugugccgggacaacuggcacggcucgaaccgccccuggguguccuucaaccagaaccuggacuaccagaugggguacaucugcagcggcgucuucggcgacaacccccggcccgaggacggggagggcuccugcaacccggugaccguggacggggcgaacggcgucaagggguucagcuacaaguacggcaacggcguguggaucgggcgcacgaaguccaaccggcugcgcaagggcuucgagaugaucugggaccccaacggguggaccaacaccgacucggacuucuccgugaagcaggacgucguggccaucaccgacuggagcggcuacagcggguccuucgugcagcaccccgagcucacgggccuggacugcauccggcccugcuucugggucgagcuggugcgcggccucccgcgggagaacaccaccaucuggaccucgggguccagcaucuccuucugcggcgucaacagcgacacggccaacugguccuggcccgacggggccgagcugcccuucaccaucgacaaguga

SEQ ID NO: 22368 - RNA, 1413 nt, Artificial Sequence; identical to SEQ ID NO: 19863
  derived and/or modified CDS sequence (AUadapt) from InfluenzaA__ADN89504__NA

SEQ ID NO: 22369 - RNA, 1413 nt, Artificial Sequence
  derived and/or modified CDS sequence (AUadapt) from InfluenzaA__ADN89515__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucaccgugaagcaggacgucguggccaucacggacugguccggguacagcggcagcuucgugcagcaccccgagcucaccggccuggacugcauccggcccugcuucugggucgagcuggugcgcgggcucccgcgggagaacaccaccaucuggacguccggcucguccaucagcuucugcggggucaacuccgacaccgccaacuggagcuggcccgacggcgccgagcugcccuucaccaucgacaaguga

SEQ ID NO: 22370 - RNA, 1413 nt, Artificial Sequence; identical to SEQ ID NO: 19863
  derived and/or modified CDS sequence (AUadapt) from InfluenzaA__ADN89526__NA

SEQ ID NO: 22371 - RNA, 1413 nt, Artificial Sequence; identical to SEQ ID NO: 22334
  derived and/or modified CDS sequence (AUadapt) from InfluenzaA__ADN89537__NA

SEQ ID NO: 22372 - RNA, 1413 nt, Artificial Sequence; identical to SEQ ID NO: 19863
  derived and/or modified CDS sequence (AUadapt) from InfluenzaA__ADN89548__NA

SEQ ID NO: 22373 - RNA, 1413 nt, Artificial Sequence; identical to SEQ ID NO: 19863
  derived and/or modified CDS sequence (AUadapt) from InfluenzaA__ADN89570__NA

SEQ ID NO: 22374 - RNA, 1413 nt, Artificial Sequence
  derived and/or modified CDS sequence (AUadapt) from InfluenzaA__ADN89581__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaagaccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgccaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggcgaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacggcgacaccgccaacuggagcuggcccgacggcgccgagcugcccuucaccaucgacaaguga

SEQ ID NO: 22375 - RNA, 1413 nt, Artificial Sequence; identical to SEQ ID NO: 21332
  derived and/or modified CDS sequence (AUadapt) from InfluenzaA__ADN89592__NA

SEQ ID NO: 22376 - RNA, 1413 nt, Artificial Sequence; identical to SEQ ID NO: 21332
  derived and/or modified CDS sequence (AUadapt) from InfluenzaA__ADN89603__NA

SEQ ID NO: 22377 - RNA, 1413 nt, Artificial Sequence; identical to SEQ ID NO: 22342
  derived and/or modified CDS sequence (AUadapt) from InfluenzaA__ADN89614__NA

SEQ ID NO: 22378 - RNA, 1413 nt, Artificial Sequence; identical to SEQ ID NO: 22361
  derived and/or modified CDS sequence (AUadapt) from InfluenzaA__ADN89625__NA

SEQ ID NO: 22379 - RNA, 1413 nt, Artificial Sequence; identical to SEQ ID NO: 19863
  derived and/or modified CDS sequence (AUadapt) from InfluenzaA__ADN89636__NA

SEQ ID NO: 22380 - RNA, 1413 nt, Artificial Sequence; identical to SEQ ID NO: 19863
  derived and/or modified CDS sequence (AUadapt) from InfluenzaA__ADN89647__NA

SEQ ID NO: 22381 - RNA, 1413 nt, Artificial Sequence; identical to SEQ ID NO: 19863
  derived and/or modified CDS sequence (AUadapt) from InfluenzaA__ADN89658__NA

SEQ ID NO: 22382 - RNA, 1413 nt, Artificial Sequence; identical to SEQ ID NO: 21332
  derived and/or modified CDS sequence (AUadapt) from InfluenzaA__ADN89669__NA

SEQ ID NO: 22383 - RNA, 1413 nt, Artificial Sequence; identical to SEQ ID NO: 19863
  derived and/or modified CDS sequence (AUadapt) from InfluenzaA__ADN89680__NA

SEQ ID NO: 22384 - RNA, 1413 nt, Artificial Sequence; identical to SEQ ID NO: 19863
  derived and/or modified CDS sequence (AUadapt) from InfluenzaA__ADN89691__NA

SEQ ID NO: 22385 - RNA, 1413 nt, Artificial Sequence; identical to SEQ ID NO: 22361
  derived and/or modified CDS sequence (AUadapt) from InfluenzaA__ADN89702__NA

SEQ ID NO: 22386 - RNA, 1413 nt, Artificial Sequence; identical to SEQ ID NO: 19863
  derived and/or modified CDS sequence (AUadapt) from InfluenzaA__ADN89713__NA

SEQ ID NO: 22387 - RNA, 1413 nt, Artificial Sequence; identical to SEQ ID NO: 19863
  derived and/or modified CDS sequence (AUadapt) from InfluenzaA__ADN89724__NA

SEQ ID NO: 22388 - RNA, 1413 nt, Artificial Sequence; identical to SEQ ID NO: 19863
  derived and/or modified CDS sequence (AUadapt) from InfluenzaA__ADN89735__NA

SEQ ID NO: 22389 - RNA, 1413 nt, Artificial Sequence; identical to SEQ ID NO: 19863
  derived and/or modified CDS sequence (AUadapt) from InfluenzaA__ADN89746__NA

SEQ ID NO: 22390 - RNA, 1413 nt, Artificial Sequence; identical to SEQ ID NO: 19863
  derived and/or modified CDS sequence (AUadapt) from InfluenzaA__ADN89757__NA

SEQ ID NO: 22391 - RNA, 1413 nt, Artificial Sequence; identical to SEQ ID NO: 19863
  derived and/or modified CDS sequence (AUadapt) from InfluenzaA__ADN89768__NA

SEQ ID NO: 22392 - RNA, 1413 nt, Artificial Sequence; identical to SEQ ID NO: 22338
  derived and/or modified CDS sequence (AUadapt) from InfluenzaA__ADN89779__NA

SEQ ID NO: 22393 - RNA, 1413 nt, Artificial Sequence; identical to SEQ ID NO: 19863
  derived and/or modified CDS sequence (AUadapt) from InfluenzaA__ADN89790__NA

SEQ ID NO: 22394 - RNA, 1413 nt, Artificial Sequence
  derived and/or modified CDS sequence (AUadapt) from InfluenzaA__ADN89801__NA
augaaccccaaccagaagaucaucaccaucggcucgaucuccaucgccaucgggaccaucagccugaugcuccagaucggcaacaucaucuccaucugggccucgcacuccauccagacggggagccagaacaacaccggcaucugcaaccagcgcaucaucaccuacaagaacuccaccugggugaaccacacguacgucaacaucaacaacaccaacgugguggcgggggaggacaagaccagcgucacccuggccggcaacuccucgcugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22395 - RNA, 1413 nt, Artificial Sequence
  derived and/or modified CDS sequence (AUadapt) from InfluenzaA__ADN89823__NA
augaaccccaaccagaagaucaucaccaucggcucgaucuccaucgccaucgggaucaucagccugaugcuccagaucggcuccaucaucagcaucugggccucccacucgauccacaccgggucccagaacaacacgggcaucugcaaccagcgcaucaucaccuacgagaacagcaccugggugaaccacaccuacgucaacaucaacaacacgaacgugguggcgggggaggacaagaccuccgucacccuggccggcaacagcucccugugcucgaucuccggcugggccaucuacaccaaggacaacagcauccggaucggguccaagggcgacguguucgugauccgcgagccguucaucagcugcucccaccucgagugccggacguucuuccugacccagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucacgggcaccaucaagagcuggaagaagcagauccugcgcacccaggaguccgagugcgugugcaugaacgggucgugcuucaccaucaugacggacggccccuccaacaaggccgccagcuacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugucguucaaccagaaccuggacuaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 22396 - RNA, 1413 nt, Artificial Sequence; identical to SEQ ID NO: 21332
  derived and/or modified CDS sequence (AUadapt) from InfluenzaA__ADN89834__NA

SEQ ID NO: 22397 - RNA, 1413 nt, Artificial Sequence; identical to SEQ ID NO: 22334
  derived and/or modified CDS sequence (AUadapt) from InfluenzaA__ADN89845__NA

SEQ ID NO: 22398 - RNA, 1413 nt, Artificial Sequence; identical to SEQ ID NO: 19863
  derived and/or modified CDS sequence (AUadapt) from InfluenzaA__ADN89856__NA

SEQ ID NO: 22399 - RNA, 1410 nt, Artificial Sequence; identical to SEQ ID NO: 21812
  derived and/or modified CDS sequence (AUadapt) from InfluenzaA__ADN89867__NA

SEQ ID NO: 22400 - RNA, 1410 nt, Artificial Sequence; identical to SEQ ID NO: 21812
  derived and/or modified CDS sequence (AUadapt) from InfluenzaA__ADN89878__NA

SEQ ID NO: 22401 - RNA, 1410 nt, Artificial Sequence; identical to SEQ ID NO: 21812
  derived and/or modified CDS sequence (AUadapt) from InfluenzaA__ADN89889__NA

SEQ ID NO: 22402 - RNA, 1410 nt, Artificial Sequence; identical to SEQ ID NO: 21812
  derived and/or modified CDS sequence (AUadapt) from InfluenzaA__ADN89900__NA

SEQ ID NO: 22403 - RNA, 1410 nt, Artificial Sequence; identical to SEQ ID NO: 21812
  derived and/or modified CDS sequence (AUadapt) from InfluenzaA__ADN89911__NA

SEQ ID NO: 22404 - RNA, 1410 nt, Artificial Sequence
  derived and/or modified CDS sequence (AUadapt) from InfluenzaA__ADN89922__NA
augaaccccaaccagaagaucaucaccaucggcucggugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaacaucaugcccaucuga

SEQ ID NO: 22405 - RNA, 1410 nt, Artificial Sequence; identical to SEQ ID NO: 21812
  derived and/or modified CDS sequence (AUadapt) from InfluenzaA__ADN89933__NA

SEQ ID NO: 22406 - RNA, 1410 nt, Artificial Sequence; identical to SEQ ID NO: 21812
  derived and/or modified CDS sequence (AUadapt) from InfluenzaA__ADN89955__NA

SEQ ID NO: 22407 - RNA, 1410 nt, Artificial Sequence; identical to SEQ ID NO: 21812
  derived and/or modified CDS sequence (AUadapt) from InfluenzaA__ADN89966__NA

SEQ ID NO: 22408 - RNA, 1410 nt, Artificial Sequence; identical to SEQ ID NO: 21812
  derived and/or modified CDS sequence (AUadapt) from InfluenzaA__ADN89977__NA

SEQ ID NO: 22409 - RNA, 1410 nt, Artificial Sequence; identical to SEQ ID NO: 21812
  derived and/or modified CDS sequence (AUadapt) from InfluenzaA__ADN89988__NA

SEQ ID NO: 22410 - RNA, 1410 nt, Artificial Sequence; identical to SEQ ID NO: 21812
  derived and/or modified CDS sequence (AUadapt) from InfluenzaA__ADN89999__NA

SEQ ID NO: 22411 - RNA, 1410 nt, Artificial Sequence; identical to SEQ ID NO: 21812
  derived and/or modified CDS sequence (AUadapt) from InfluenzaA__ADN90010__NA

SEQ ID NO: 22412 - RNA, 1410 nt, Artificial Sequence; identical to SEQ ID NO: 21812
  derived and/or modified CDS sequence (AUadapt) from InfluenzaA__ADN90021__NA

SEQ ID NO: 22413 - RNA, 1410 nt, Artificial Sequence; identical to SEQ ID NO: 21812
  derived and/or modified CDS sequence (AUadapt) from InfluenzaA__ADN90032__NA

SEQ ID NO: 22414 - RNA, 1410 nt, Artificial Sequence; identical to SEQ ID NO: 21812
  derived and/or modified CDS sequence (AUadapt) from InfluenzaA__ADN90043__NA

SEQ ID NO: 22415 - RNA, 1410 nt, Artificial Sequence; identical to SEQ ID NO: 21812
  derived and/or modified CDS sequence (AUadapt) from InfluenzaA__ADN90054__NA

SEQ ID NO: 22416 - RNA, 1410 nt, Artificial Sequence; identical to SEQ ID NO: 21812
  derived and/or modified CDS sequence (AUadapt) from InfluenzaA__ADN90065__NA

SEQ ID NO: 22417 - RNA, 1410 nt, Artificial Sequence; identical to SEQ ID NO: 21812
  derived and/or modified CDS sequence (AUadapt) from InfluenzaA__ADN90076__NA

SEQ ID NO: 22418 - RNA, 1410 nt, Artificial Sequence; identical to SEQ ID NO: 21812
  derived and/or modified CDS sequence (AUadapt) from InfluenzaA__ADN90087__NA

SEQ ID NO: 22419 - RNA, 1410 nt, Artificial Sequence; identical to SEQ ID NO: 21812
  derived and/or modified CDS sequence (AUadapt) from InfluenzaA__ADN90098__NA

SEQ ID NO: 22420 - RNA, 1410 nt, Artificial Sequence; identical to SEQ ID NO: 21812
  derived and/or modified CDS sequence (AUadapt) from InfluenzaA__ADN90109__NA

SEQ ID NO: 22421 - RNA, 1410 nt, Artificial Sequence; identical to SEQ ID NO: 21812
  derived and/or modified CDS sequence (AUadapt) from InfluenzaA__ADN90120__NA

SEQ ID NO: 22422 - RNA, 1410 nt, Artificial Sequence; identical to SEQ ID NO: 21812
  derived and/or modified CDS sequence (AUadapt) from InfluenzaA__ADN90131__NA

SEQ ID NO: 22423 - RNA, 1410 nt, Artificial Sequence; identical to SEQ ID NO: 21812
  derived and/or modified CDS sequence (AUadapt) from InfluenzaA__ADN90142__NA

SEQ ID NO: 22424 - RNA, 1410 nt, Artificial Sequence; identical to SEQ ID NO: 21812
  derived and/or modified CDS sequence (AUadapt) from InfluenzaA__ADN90153__NA

SEQ ID NO: 22425 - RNA, 1410 nt, Artificial Sequence; identical to SEQ ID NO: 21812
  derived and/or modified CDS sequence (AUadapt) from InfluenzaA__ADN90164__NA

SEQ ID NO: 22426 - RNA, 1410 nt, Artificial Sequence; identical to SEQ ID NO: 21812
  derived and/or modified CDS sequence (AUadapt) from InfluenzaA__ADN90186__NA

SEQ ID NO: 22427 - RNA, 1410 nt, Artificial Sequence; identical to SEQ ID NO: 21812
  derived and/or modified CDS sequence (AUadapt) from InfluenzaA__ADN90197__NA

SEQ ID NO: 22428 - RNA, 1410 nt, Artificial Sequence
  derived and/or modified CDS sequence (AUadapt) from InfluenzaA__ADN90208__NA
augaaccccaaccagaagaucaucaccaucggcucggugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccgguccaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcacguccggcaccuacgggaccggcagcuggccggacggggccgaccugaaccucaugcccaucuga

SEQ ID NO: 22429 - RNA, 1410 nt, Artificial Sequence; identical to SEQ ID NO: 21812
  derived and/or modified CDS sequence (AUadapt) from InfluenzaA__ADN90219__NA

SEQ ID NO: 22430 - RNA, 1410 nt, Artificial Sequence
  derived and/or modified CDS sequence (AUadapt) from InfluenzaA__ADN92469__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucggagaaggccgacaccaagauccucuucaucgaggagggcaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcgggcuggugggcgacacgccccggaagaacgacuccucguccagcucccacugccucgaccccaacaacgaggagggcgggcacggcgucaaggggugggccuucgacgacggcaacgacguguggauggggcgcaccaucucggagaagucccggcugggcuacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 22431 - RNA, 1410 nt, Artificial Sequence; identical to SEQ ID NO: 21657
  derived and/or modified CDS sequence (AUadapt) from InfluenzaA__ADN92480__NA

SEQ ID NO: 22432 - RNA, 1410 nt, Artificial Sequence; identical to SEQ ID NO: 21657
  derived and/or modified CDS sequence (AUadapt) from InfluenzaA__ADN92491__NA

SEQ ID NO: 22433 - RNA, 1410 nt, Artificial Sequence
  derived and/or modified CDS sequence (AUadapt) from InfluenzaA__ADN92502__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggaacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaacgaggugcuguggaccuccaacagcaucgucguguucugcggcaccuccgggaccuacggcacggggagcuggccggacggcgccgacaucaaccugaugcccaucuga

SEQ ID NO: 22434 - RNA, 1410 nt, Artificial Sequence; identical to SEQ ID NO: 16318
  derived and/or modified CDS sequence (AUadapt) from InfluenzaA__ADN92512__NA

SEQ ID NO: 22435 - RNA, 1410 nt, Artificial Sequence; identical to SEQ ID NO: 16318
  derived and/or modified CDS sequence (AUadapt) from InfluenzaA__ADN92522__NA

SEQ ID NO: 22436 - RNA, 1410 nt, Artificial Sequence; identical to SEQ ID NO: 16318
  derived and/or modified CDS sequence (AUadapt) from InfluenzaA__ADN92532__NA

SEQ ID NO: 22437 - RNA, 1410 nt, Artificial Sequence; identical to SEQ ID NO: 16318
  derived and/or modified CDS sequence (AUadapt) from InfluenzaA__ADN92542__NA

SEQ ID NO: 22438 - RNA, 1410 nt, Artificial Sequence; identical to SEQ ID NO: 16318
  derived and/or modified CDS sequence (AUadapt) from InfluenzaA__ADN92552__NA

SEQ ID NO: 22439 - RNA, 1410 nt, Artificial Sequence; identical to SEQ ID NO: 16318
  derived and/or modified CDS sequence (AUadapt) from InfluenzaA__ADO00733__NA

SEQ ID NO: 22440 - RNA, 1410 nt, Artificial Sequence
  derived and/or modified CDS sequence (AUadapt) from InfluenzaA__ADO00743__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgccaagcuggccgggaacucgucccucugcccggugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcauccgccaggacaucgucgggaucaacgagugguccggcuacucgggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgcggagcugccguucacgaucgacaaguga

SEQ ID NO: 22441 - RNA, 1410 nt, Artificial Sequence; identical to SEQ ID NO: 20317
  derived and/or modified CDS sequence (AUadapt) from InfluenzaA__ADO00753__NA

SEQ ID NO: 22442 - RNA, 1410 nt, Artificial Sequence; identical to SEQ ID NO: 16318
  derived and/or modified CDS sequence (AUadapt) from InfluenzaA__ADO12146__NA

SEQ ID NO: 22443 - RNA, 1410 nt, Artificial Sequence; identical to SEQ ID NO: 16318
  derived and/or modified CDS sequence (AUadapt) from InfluenzaA__ADO12156__NA

SEQ ID NO: 22444 - RNA, 1410 nt, Artificial Sequence; identical to SEQ ID NO: 16318
  derived and/or modified CDS sequence (AUadapt) from InfluenzaA__ADO12166__NA

SEQ ID NO: 22445 - RNA, 1410 nt, Artificial Sequence; identical to SEQ ID NO: 16318
  derived and/or modified CDS sequence (AUadapt) from InfluenzaA__ADO12176__NA

SEQ ID NO: 22446 - RNA, 1410 nt, Artificial Sequence; identical to SEQ ID NO: 16318
  derived and/or modified CDS sequence (AUadapt) from InfluenzaA__ADO12186__NA

SEQ ID NO: 22447 - RNA, 1410 nt, Artificial Sequence; identical to SEQ ID NO: 16318
  derived and/or modified CDS sequence (AUadapt) from InfluenzaA__ADO12196__NA

SEQ ID NO: 22448 - RNA, 1410 nt, Artificial Sequence; identical to SEQ ID NO: 16318
  derived and/or modified CDS sequence (AUadapt) from InfluenzaA__ADO12206__NA

SEQ ID NO: 22449 - RNA, 1410 nt, Artificial Sequence; identical to SEQ ID NO: 16318
  derived and/or modified CDS sequence (AUadapt) from InfluenzaA__ADO12216__NA

SEQ ID NO: 22450 - RNA, 1410 nt, Artificial Sequence; identical to SEQ ID NO: 16318
  derived and/or modified CDS sequence (AUadapt) from InfluenzaA__ADO12226__NA

SEQ ID NO: 22451 - RNA, 1410 nt, Artificial Sequence; identical to SEQ ID NO: 16318
  derived and/or modified CDS sequence (AUadapt) from InfluenzaA__ADO12246__NA

SEQ ID NO: 22452 - RNA, 1410 nt, Artificial Sequence; identical to SEQ ID NO: 16318
  derived and/or modified CDS sequence (AUadapt) from InfluenzaA__ADO12266__NA

SEQ ID NO: 22453 - RNA, 1410 nt, Artificial Sequence
  derived and/or modified CDS sequence (AUadapt) from InfluenzaA__ADO12276__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagucgggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugaccggccuggacugcauccgccccugcuucugggucgagcucauccggggccgccccaaggagaacacgaucuggaccuccgggagcuccaucagcuucugcggcgugaacuccgacaccgucggguggagcuggcccgacggcgccgagcugccguucaccaucgacaaguga

SEQ ID NO: 22454 - RNA, 1410 nt, Artificial Sequence; identical to SEQ ID NO: 16318
  derived and/or modified CDS sequence (AUadapt) from InfluenzaA__ADO12286__NA

SEQ ID NO: 22455 - RNA, 1410 nt, Artificial Sequence; identical to SEQ ID NO: 16318
  derived and/or modified CDS sequence (AUadapt) from InfluenzaA__ADO12296__NA

SEQ ID NO: 22456 - RNA, 1410 nt, Artificial Sequence; identical to SEQ ID NO: 16318
  derived and/or modified CDS sequence (AUadapt) from InfluenzaA__ADO12306__NA

SEQ ID NO: 22457 - RNA, 1410 nt, Artificial Sequence
  derived and/or modified CDS sequence (AUadapt) from InfluenzaA__ADO12316__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcgacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22458 - RNA, 1410 nt, Artificial Sequence; identical to SEQ ID NO: 16318
  derived and/or modified CDS sequence (AUadapt) from InfluenzaA__ADO12326__NA

SEQ ID NO: 22459 - RNA, 1410 nt, Artificial Sequence; identical to SEQ ID NO: 16318
  derived and/or modified CDS sequence (AUadapt) from InfluenzaA__ADO12336__NA

SEQ ID NO: 22460 - RNA, 1410 nt, Artificial Sequence; identical to SEQ ID NO: 16318
  derived and/or modified CDS sequence (AUadapt) from InfluenzaA__ADO12346__NA

SEQ ID NO: 22461 - RNA, 1410 nt, Artificial Sequence; identical to SEQ ID NO: 16318
  derived and/or modified CDS sequence (AUadapt) from InfluenzaA__ADO12356__NA

SEQ ID NO: 22462 - RNA, 1410 nt, Artificial Sequence; identical to SEQ ID NO: 16318
  derived and/or modified CDS sequence (AUadapt) from InfluenzaA__ADO12366__NA

SEQ ID NO: 22463 - RNA, 1410 nt, Artificial Sequence; identical to SEQ ID NO: 16318
  derived and/or modified CDS sequence (AUadapt) from InfluenzaA__ADO12376__NA

SEQ ID NO: 22464 - RNA, 1410 nt, Artificial Sequence; identical to SEQ ID NO: 16318
  derived and/or modified CDS sequence (AUadapt) from InfluenzaA__ADO12386__NA

SEQ ID NO: 22465 - RNA, 1410 nt, Artificial Sequence; identical to SEQ ID NO: 16318
  derived and/or modified CDS sequence (AUadapt) from InfluenzaA__ADO12396__NA

SEQ ID NO: 22466 - RNA, 1410 nt, Artificial Sequence; identical to SEQ ID NO: 16318
  derived and/or modified CDS sequence (AUadapt) from InfluenzaA__ADO12406__NA

SEQ ID NO: 22467 - RNA, 1410 nt, Artificial Sequence; identical to SEQ ID NO: 19907
  derived and/or modified CDS sequence (AUadapt) from InfluenzaA__ADO12416__NA

SEQ ID NO: 22468 - RNA, 1410 nt, Artificial Sequence; identical to SEQ ID NO: 16318
  derived and/or modified CDS sequence (AUadapt) from InfluenzaA__ADO12426__NA

SEQ ID NO: 22469 - RNA, 1410 nt, Artificial Sequence; identical to SEQ ID NO: 16318
  derived and/or modified CDS sequence (AUadapt) from InfluenzaA__ADO12436__NA

SEQ ID NO: 22470 - RNA, 1410 nt, Artificial Sequence; identical to SEQ ID NO: 16318
  derived and/or modified CDS sequence (AUadapt) from InfluenzaA__ADO12446__NA

SEQ ID NO: 22471 - RNA, 1410 nt, Artificial Sequence; identical to SEQ ID NO: 16318
  derived and/or modified CDS sequence (AUadapt) from InfluenzaA__ADO12456__NA

SEQ ID NO: 22472 - RNA, 1410 nt, Artificial Sequence; identical to SEQ ID NO: 16318
  derived and/or modified CDS sequence (AUadapt) from InfluenzaA__ADO12466__NA

SEQ ID NO: 22473 - RNA, 1410 nt, Artificial Sequence; identical to SEQ ID NO: 16318
  derived and/or modified CDS sequence (AUadapt) from InfluenzaA__ADO12476__NA

SEQ ID NO: 22474 - RNA, 1410 nt, Artificial Sequence; identical to SEQ ID NO: 16318
  derived and/or modified CDS sequence (AUadapt) from InfluenzaA__ADO12486__NA

SEQ ID NO: 22475 - RNA, 1410 nt, Artificial Sequence; identical to SEQ ID NO: 16318
  derived and/or modified CDS sequence (AUadapt) from InfluenzaA__ADO12496__NA

SEQ ID NO: 22476 - RNA, 1410 nt, Artificial Sequence; identical to SEQ ID NO: 16318
  derived and/or modified CDS sequence (AUadapt) from InfluenzaA__ADO12506__NA

SEQ ID NO: 22477 - RNA, 1410 nt, Artificial Sequence; identical to SEQ ID NO: 16318
  derived and/or modified CDS sequence (AUadapt) from InfluenzaA__ADO12516__NA

SEQ ID NO: 22478 - RNA, 1410 nt, Artificial Sequence; identical to SEQ ID NO: 16318
  derived and/or modified CDS sequence (AUadapt) from InfluenzaA__ADO12526__NA

SEQ ID NO: 22479 - RNA, 1410 nt, Artificial Sequence; identical to SEQ ID NO: 16318
  derived and/or modified CDS sequence (AUadapt) from InfluenzaA__ADO12536__NA

SEQ ID NO: 22480 - RNA, 1410 nt, Artificial Sequence; identical to SEQ ID NO: 16318
  derived and/or modified CDS sequence (AUadapt) from InfluenzaA__ADO12546__NA

SEQ ID NO: 22481 - RNA, 1410 nt, Artificial Sequence; identical to SEQ ID NO: 16318
  derived and/or modified CDS sequence (AUadapt) from InfluenzaA__ADO12556__NA

SEQ ID NO: 22482 - RNA, 1410 nt, Artificial Sequence; identical to SEQ ID NO: 16318
  derived and/or modified CDS sequence (AUadapt) from InfluenzaA__ADO12566__NA

SEQ ID NO: 22483 - RNA, 1410 nt, Artificial Sequence; identical to SEQ ID NO: 16318
  derived and/or modified CDS sequence (AUadapt) from InfluenzaA__ADO12576__NA

SEQ ID NO: 22484 - RNA, 1410 nt, Artificial Sequence
  derived and/or modified CDS sequence (AUadapt) from InfluenzaA__ADO12586__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacagcggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22485 - RNA, 1410 nt, Artificial Sequence; identical to SEQ ID NO: 22484
  derived and/or modified CDS sequence (AUadapt) from InfluenzaA__ADO12596__NA

SEQ ID NO: 22486 - RNA, 1410 nt, Artificial Sequence; identical to SEQ ID NO: 16318
  derived and/or modified CDS sequence (AUadapt) from InfluenzaA__ADO12606__NA

SEQ ID NO: 22487 - RNA, 1410 nt, Artificial Sequence; identical to SEQ ID NO: 16318
  derived and/or modified CDS sequence (AUadapt) from InfluenzaA__ADO12616__NA

SEQ ID NO: 22488 - RNA, 1410 nt, Artificial Sequence; identical to SEQ ID NO: 16318
  derived and/or modified CDS sequence (AUadapt) from InfluenzaA__ADO12626__NA

SEQ ID NO: 22489 - RNA, 1410 nt, Artificial Sequence; identical to SEQ ID NO: 16318
  derived and/or modified CDS sequence (AUadapt) from InfluenzaA__ADO14355__NA

SEQ ID NO: 22490 - RNA, 1401 nt, Artificial Sequence
  derived and/or modified CDS sequence (AUadapt) from InfluenzaA__ADO21028__NA
augaaccccaaccagaagaucaucgccaucggcucggugucccugaccaucgccaccaucugcuuccucaugcagaucgcgauccuggccacgaccaugacccugcacuucaagcagaacgagugcucgaacccguccaacaaccaggucgugcccugcgagcccaccaucaucgagcgcaacaucgugcaccucaacucgacgaccaucgagaaggagaucugccccaaggucgccgaguacaagaacugguccaagccgcagugccagaucaccgggagcgcccccuucuccaagggcaacucgauccggcuguccgccgggggcgacaucugggugacccgcgagcccuacgugucgugcucccuggggaagugcuaccaguucgcgcucggccagggcacgacccugaagaacaagcacucgaacgggaccacccacgaccgggucccccaccgcacgcugcucauguccgagcugggcgugccguuccaccuggggaccaagcaggucugcaucgccuggagcuccucguccugccacgacggcaaggccuggcuccacgugugcgugaccggggacgacaagaacgccaccgcgucgaucaucuacgacggcaugcugguggacuccaucggcucguggagcaagaacauccugcggacgcaggaguccgagugcgucugcaucaacgggaccugcaccguggugaugaccgacggcucggccuccgggaaggccgacacgcgcauccucuucauccgggagggcaagaucguccacaucucgccccuguccggcagcgcccagcacguggaggagugcuccugcuacccccgcuaccccgaggugcggugcgucugccgcgacaacuggaaggggucgaaccggccggugcuguacaucaacauggccgacuacuccaucgagucguccuacgugugcucgggccucgucggggacacgccccgcaacgacgacuccuacagcuccucgaacugccgggaccccaacaacgagcgcggcgcgcccggggugaagggcugggccuucgacaacggcaacgacaucuggauggggcggaccaucaaggaggacucccgcucgggcuacgagaccuuccggguggucgggggcuggaccaccgccaacuccaagucgcagaucaaccgccaggugaucgucgacagcgacaacugguccggguacucgggcaucuucuccguggagggcaagaacugcaucaaccggugcuucuacguggagcugauccgcgggcggccgcaggagacccgcgucugguggaccucgaacuccaucaucguguucugcggcacgagcgggaccuacggcaccggguccuggcccgacggcgccaacaucaacuucaugcccaucuga

SEQ ID NO: 22491 - RNA, 1401 nt, Artificial Sequence
  derived and/or modified CDS sequence (AUadapt) from InfluenzaA__ADO21039__NA
augaaccccaaccagaagaucaucgccaucggcucggugucccugaccaucgccaccaucugcuuccucaugcagaucgcgauccuggccacgaccaugacccugcacuucaagcagaacgagugcucgaacccguccaacaaccaggucgugcccugcgagcccaccaucaucgagcgcaacaucgugcaccucaacucgacgaccaucgagaaggagaucugccccaaggucgccgaguacaagaacugguccaagccgcagugccagaucaccgggucggcccccuucuccaagggcaacucgauccggcuguccgccgggggcgacaucugggugacccgcgagcccuacgugagcugcucccuggggaagugcuaccaguucgcgcucggccagggcacgacccugaagaacaagcacucgaacgggaccacccacgaccgggacccccaccgcacgcugcucauguccgagcugggcgucccguuccaccuggggaccaagcaggucugcaucgccuggucguccucguccugccacgacggcaaggccuggcuccacgugugcgugaccggggacgacaagaacgccaccgcgucgaucaucuacgacggcaugcugguggacuccaucggcagcuggucgaagaacauccugcggacgcaggaguccgagugcgugugcaucaacgggaccugcaccgucgugaugaccgacggcucggccuccgggaaggccgacacgcgcauccucuucauccgggagggcaagaucgugcacaucucgccccuguccggcucggcccagcacgucgaggagugcuccugcuacccccgcuaccccgaggugcggugcgugugccgcgacaacuggaaggggagcaaccggccgguccuguacaucaacauggccgacuacaccaucgaguccucguacgugugcuccggccucgugggggacacgccccgcaacgacgacucguacuccucguccaacugccgggaccccaacaacgagcgcggcgcgcccggggucaagggcugggccuucgacaacggcaacgacaucuggauggggcggaccaucaaggaggacucgcgcuccggcuacgagaccuuccggguggucgggggcuggaccaccgccaacagcaagucccagaucaaccgccaggugaucguggacucggacaacuggucgggguacuccggcaucuucucggucgagggcaagaacugcaucaaccggugcuucuacguggagcugauccgcgggcggccgcaggagacccgcgugugguggacguccaacucgaucaucgucuucugcggcaccuccgggaccuacggcaccgggagcuggcccgacggcgccaacaucaacuucaugcccaucuga

SEQ ID NO: 22492 - RNA, 1401 nt, Artificial Sequence
  derived and/or modified CDS sequence (AUadapt) from InfluenzaA__ADO21050__NA
augaaccccaaccagaagaucaucgccaucggcucggugucccugaccaucgccaccaucugcuuccucaugcagaucgcgauccuggccacgaccaugacccugcacuucaagcagaacgagugcucgaacccguccaacaaccaggucgugcccugcgagcccaccaucaucgagcgcaacaucgugcaccucaacucgacgaccaucgagaaggagaucugccccaaggucgccgaguacaagaacugguccaagccgcagugccagaucaccgggagcgcccccuucuccaagggcaacucgauccggcuguccgccgggggcgacaucugggugacccgcgagcccuacgugucgugcucccuggggaagugcuaccaguucgcgcucggccagggcacgacccugaagaacaagcacucgaacgggaccacccacgaccggggcccccaccgcacgcugcucauguccgagcugggggucccguuccaccugggcaccaagcaggucugcaucgccuggagcuccucguccugccacgacgggaaggccuggcuccacgugugcgugaccggcgacgacaagaacgccaccgcgucgaucaucuacgacggcaugcugguggacuccaucgggucguggagcaagaacauccugcggacgcaggaguccgagugcgugugcaucaacgggaccugcaccgucgugaugaccgacggcucggccuccggcaaggccgacacgcgcauccucuucauccgggagggcaagaucgugcacaucucgccccuguccgggucggcccagcacgucgaggagugcuccugcuacccccgcuaccccgaggugcggugcgugugccgcgacaacuggaagggcagcaaccggccgguccuguacaucaacauggccgacuacuccaucgagucguccuacgugugcucggggcucgugggcgacacgccccgcaacgacgacuccuacucguccagcaacugccgggaccccaacaacgaguccggggcgcccggcgucaagggcugggccuucgacaacgggaacgacaucuggaugggccgcaccaucaaggaggacucgcgguccggguacgagaccuuccgcguggugggcggguggaccaccgccaacucgaagucgcagaucaaccggcaggucaucguggacuccgacaacuggagcggcuacuccggcaucuucucggucgaggggaagaacugcaucaaccgcugcuucuacguggagcugauccggggccgcccgcaggagacccgggugugguggaccuccaacucgaucaucgucuucugcgggacguccggcaccuacgggaccggcagcuggcccgacggcgccaacaucaacuucaugcccaucuga

SEQ ID NO: 22493 - RNA, 1410 nt, Artificial Sequence
  derived and/or modified CDS sequence (AUadapt) from InfluenzaA__ADO25095__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcggccccgucuccagcaacggggccaacggcgugaagggguucuccuucaaguacggcaacgggguguggaucggccgcaccaagagcaucagcucccggagcggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 22494 - RNA, 1410 nt, Artificial Sequence
  derived and/or modified CDS sequence (AUadapt) from InfluenzaA__ADO25105__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucggcacgugcaaccagagcgucaucaccuacgagaccaacaccugggugaaccagacguacgugaacaucuccaacaccaacuucgccgcggggcagagcgucguguccgugaagcuggccggcaacucgucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcacgaucaaggaccggucccccuaccgcacccugaugucgugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacacgaucaagagcuggcgcaacaacauccugcggacccaggaguccgagugcgcgugcgugaacggcucgugcuucaccgugaugaccgacggcccguccgaccgccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcacggacaacaacuucucgaucaagcaggacaucguggggaucaacgagugguccggcuacagcggguccuucgugcagcacccggagcugaccggccuggacugcauccggcccugcuucugggucgagcucauccgcggccggcccaaggagaacaccaucuggaccagcggguccagcaucuccuucugcggcgugaacagcgacacggucgggugguccuggcccgacggcgccgagcugccguucaccaucgacaaguga

SEQ ID NO: 22495 - RNA, 1410 nt, Artificial Sequence; identical to SEQ ID NO: 20921
  derived and/or modified CDS sequence (AUadapt) from InfluenzaA__ADO25115__NA

SEQ ID NO: 22496 - RNA, 1410 nt, Artificial Sequence; identical to SEQ ID NO: 20921
  derived and/or modified CDS sequence (AUadapt) from InfluenzaA__ADO25125__NA

SEQ ID NO: 22497 - RNA, 1410 nt, Artificial Sequence
  derived and/or modified CDS sequence (AUadapt) from InfluenzaA__ADO25135__NA
augaaccccaaccagaagaucaucaccaucggcucggugugcaugaccaucgggauggccaaccugguccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22498 - RNA, 1410 nt, Artificial Sequence; identical to SEQ ID NO: 20491
  derived and/or modified CDS sequence (AUadapt) from InfluenzaA__ADO25145__NA

SEQ ID NO: 22499 - RNA, 1410 nt, Artificial Sequence; identical to SEQ ID NO: 16318
  derived and/or modified CDS sequence (AUadapt) from InfluenzaA__ADO25155__NA

SEQ ID NO: 22500 - RNA, 1410 nt, Artificial Sequence; identical to SEQ ID NO: 16318
  derived and/or modified CDS sequence (AUadapt) from InfluenzaA__ADO25165__NA

SEQ ID NO: 22501 - RNA, 1410 nt, Artificial Sequence; identical to SEQ ID NO: 16318
  derived and/or modified CDS sequence (AUadapt) from InfluenzaA__ADO25175__NA

SEQ ID NO: 22502 - RNA, 1410 nt, Artificial Sequence
  derived and/or modified CDS sequence (AUadapt) from InfluenzaA__ADO25185__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaugagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22503 - RNA, 1410 nt, Artificial Sequence; identical to SEQ ID NO: 21569
  derived and/or modified CDS sequence (AUadapt) from InfluenzaA__ADO25195__NA

SEQ ID NO: 22504 - RNA, 1410 nt, Artificial Sequence; identical to SEQ ID NO: 20277
  derived and/or modified CDS sequence (AUadapt) from InfluenzaA__ADO25205__NA

SEQ ID NO: 22505 - RNA, 1410 nt, Artificial Sequence; identical to SEQ ID NO: 20491
  derived and/or modified CDS sequence (AUadapt) from InfluenzaA__ADO25215__NA

SEQ ID NO: 22506 - RNA, 1410 nt, Artificial Sequence; identical to SEQ ID NO: 16318
  derived and/or modified CDS sequence (AUadapt) from InfluenzaA__ADO25225__NA

SEQ ID NO: 22507 - RNA, 1410 nt, Artificial Sequence; identical to SEQ ID NO: 20491
  derived and/or modified CDS sequence (AUadapt) from InfluenzaA__ADO25235__NA

SEQ ID NO: 22508 - RNA, 1410 nt, Artificial Sequence; identical to SEQ ID NO: 16318
  derived and/or modified CDS sequence (AUadapt) from InfluenzaA__ADO25245__NA

SEQ ID NO: 22509 - RNA, 1410 nt, Artificial Sequence; identical to SEQ ID NO: 16318
  derived and/or modified CDS sequence (AUadapt) from InfluenzaA__ADO25255__NA

SEQ ID NO: 22510 - RNA, 1410 nt, Artificial Sequence; identical to SEQ ID NO: 20921
  derived and/or modified CDS sequence (AUadapt) from InfluenzaA__ADO25265__NA

SEQ ID NO: 22511 - RNA, 1410 nt, Artificial Sequence; identical to SEQ ID NO: 20732
  derived and/or modified CDS sequence (AUadapt) from InfluenzaA__ADO25275__NA

SEQ ID NO: 22512 - RNA, 1410 nt, Artificial Sequence; identical to SEQ ID NO: 20491
  derived and/or modified CDS sequence (AUadapt) from InfluenzaA__ADO25285__NA

SEQ ID NO: 22513 - RNA, 1413 nt, Artificial Sequence
  derived and/or modified CDS sequence (AUadapt) from InfluenzaA__ADO27623__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacguggcggccggggaggacaagaccagcgugacccuggccggcaacuccucgcugugcuccaucagcggcugggccaucuacaccaaggacaacuccauccggaucgggucgaagggcgacgucuucgugauccgcgagccguucaucuccugcagccaccucgagugccggacguucuuccugacccagggggcccugcucaacgacaagcacuccaacggcaccgugaaggaccgcagccccuaccgggcgcugauguccugcccccugggggaggcccccucgccguacaacagcaaguucgaguccgucgccuggagcgccuccgcgugccacgacggcaugggcuggcucaccaucgggaucucgggccccgacaacggggccguggccgugcugaaguacaacggcaucaucacgggcaccaucaaguccuggaagaagcagauccugcgcacccaggagagcgagugcgucugcaugaacggguccugcuucaccaucaugacggacggccccucgaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgggacaacuggcacgggagcaaccgccccuggguguccuucaaccagaaccuggacuaccagaucggcuacaucugcucgggcguguucggggacaacccccggcccgaggacggcgagggguccugcaacccggucaccguggacggcgccaacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggacugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 22514 - RNA, 1410 nt, Artificial Sequence; identical to SEQ ID NO: 16318
  derived and/or modified CDS sequence (AUadapt) from InfluenzaA__ADO30410__NA

SEQ ID NO: 22515 - RNA, 1410 nt, Artificial Sequence; identical to SEQ ID NO: 20491
  derived and/or modified CDS sequence (AUadapt) from InfluenzaA__ADO30420__NA

SEQ ID NO: 22516 - RNA, 1410 nt, Artificial Sequence; identical to SEQ ID NO: 19848
  derived and/or modified CDS sequence (AUadapt) from InfluenzaA__ADP95343__NA

SEQ ID NO: 22517 - RNA, 1410 nt, Artificial Sequence; identical to SEQ ID NO: 16274
  derived and/or modified CDS sequence (AUadapt) from InfluenzaA__ADP95353__NA

SEQ ID NO: 22518 - RNA, 1410 nt, Artificial Sequence; identical to SEQ ID NO: 16274
  derived and/or modified CDS sequence (AUadapt) from InfluenzaA__ADP95363__NA

SEQ ID NO: 22519 - RNA, 1410 nt, Artificial Sequence; identical to SEQ ID NO: 16274
  derived and/or modified CDS sequence (AUadapt) from InfluenzaA__ADP95373__NA

SEQ ID NO: 22520 - RNA, 1410 nt, Artificial Sequence; identical to SEQ ID NO: 16274
  derived and/or modified CDS sequence (AUadapt) from InfluenzaA__ADP95383__NA

SEQ ID NO: 22521 - RNA, 1410 nt, Artificial Sequence; identical to SEQ ID NO: 16274
  derived and/or modified CDS sequence (AUadapt) from InfluenzaA__ADP95393__NA

SEQ ID NO: 22522 - RNA, 1410 nt, Artificial Sequence
  derived and/or modified CDS sequence (AUadapt) from InfluenzaA__ADQ43774__NA
augaaccccaaccagaagaucaucaccaucggcucggggugcaugaccaucggcauggccaaccugauccuccagaucgggaacaucaucuccaucuggaucagccacuccauccagcugggcaaccagaaccagaucgagacgugcaaccagagcgugaucaccuacgagaacaacaccugggucaaccagaccuacgugaacaucuccaacacgaacuucgccgcggggcagagcguggucuccgugaagcuggccggcaacucgucccucugcccggugagcggcugggccaucuacuccaaggacaacagcauccgcaucggguccaagggcgacgucuucgugauccgggagcccuucaucagcugcucgccccuggagugccgcaccuucuuccugacccagggggcccuccugaacgacaagcacuccaacggcaccaucaaggaccggucccccuaccgcacgcugaugagcugcccgaucggggaggugcccucccccuacaacagccgguucgagagcgucgccugguccgcgucggccugccacgacggcaucaacuggcucaccaucggcaucuccgggcccgacaacggcgccguggccgugcugaaguacaacgggaucaucaccgacaccaucaagagcuggcgcaacaacauccugcggacgcaggaguccgagugcgcgugcgucaacggcagcugcuucaccgugaugaccgacggcccguccgacgggcaggccagcuacaagaucuuccgcaucgagaagggcaagaucgugaaguccgucgagaugaaggcccccaacuaccacuacgaggagugcucgugcuaccccgacuccagcgagaucacgugcgugugccgggacaacuggcacggguccaaccgccccugggugagcuucaaccagaaccucgaguaccagaucggcuacaucugcuccgggaucuucggcgacaacccgcggcccaacgacaagaccggcagcugcgggcccgucuccucgaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacucgggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 22523 - RNA, 1410 nt, Artificial Sequence
  derived and/or modified CDS sequence (AUadapt) from InfluenzaA__ADQ92578__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugauccugugcgagcccacgaucaucgagcgcaacaucaccgagaucguguaccucaccaacgccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 22524 - RNA, 1410 nt, Artificial Sequence; identical to SEQ ID NO: 19001
  derived and/or modified CDS sequence (AUadapt) from InfluenzaA__ADR32364__NA

SEQ ID NO: 22525 - RNA, 1410 nt, Artificial Sequence
  derived and/or modified CDS sequence (AUadapt) from InfluenzaA__ADT64478__NA
augaaccccaaccagaagaucaucaccaucggcucggugugcaugaccaucgggauggccaaccugauccuccagaucggcaacaucaucuccaucuggaucgggcacagcauccagcugggcaaccagaaccagaucgagacgugcaaccaguccgucaucaccuacgagaacaacaccugggugaaccagaccuacgugaacaucagcaacacgaacuucgccgcggggcaguccgucgugagcgugaagcuggccggcaacuccucgcucugcccggucuccggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacucccgguucgagagcguggccuggagcgcguccgccugccacgacggcaucaacuggcucaccaucggcaucucggggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 22526 - RNA, 1410 nt, Artificial Sequence
  derived and/or modified CDS sequence (AUadapt) from InfluenzaA__ADT78889__NA
augaaccccaaccagaagaucaucaccaucggcucggugucccugaccaucgccacggucugcuuccucaugcagaucgccauccuggugaccaccgugacccugcacuucaagcagcacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccccggcaagugcuaccaguucgcccuggggcagggcaccacccucgacaacaagcacuccaacgacaccauccacgaccgcaucccgcaccggacgcugcugaugaacgagcucggcguccccuuccaccuggggacccgccaggugugcguggccuggucguccagcuccugccacgacggcaaggcguggcugcacgucugcgugaccggggacgacaagaacgccaccgccucguucaucuacgacggccggcucguggacuccaucgggucguggucccagaacauccugcgcacgcaggagagcgagugcgucugcaucaacgggaccugcaccguggugaugaccgacggcuccgccucggggcgggcggacacgcgcauccuguucaucgaggagggcaagaucguccacaucagcccccucuccgggucggcccagcacguggaggagugcuccugcuacccccgguacccggacgugcgcugcaucugccgggacaacuggaagggcagcaaccgccccgucaucgacaucaacauggaggacuacuccaucgacucguccuacgugugcagcggccuggugggggacacgccccggaacgacgaccgcuccucgaacuccaacugccgggaccccaacaacgagcgcggcaacccgggggucaagggcugggccuucgacaacggggacgacguguggaugggccggaccaucucgaaggaccugcgcuccggcuacgagaccuucaaggucaucgggggcuggagcacccccaacuccaagucgcagaucaaccgccaggugaucguggacuccaacaacuggagcggguacuccggcaucuucucggucgagggcaagagcugcaucaaccggugcuucuacguggagcucauccgcggccggcagcaggagacccgcgugugguggaccuccaacucgaucgucguguucugcggcaccuccgggacguacggcaccgggagcuggcccgacggcgccaacaucuccuucaugcccaucuga

SEQ ID NO: 22527 - RNA, 1410 nt, Artificial Sequence
  derived and/or modified CDS sequence (AUadapt) from InfluenzaA__ADT78899__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucaugcgggagcccuacgugagcugcaaccccggcaagugcuaccaguucgcccuggggcagggcacgacccucgacaacaagcacuccaacggcaccauccacgaccgcaucccgcaccggacccugcugaugaacgagcucggggugcccuuccaccugggcacgaagcaggucugcguggcguggucguccagcuccugccacgacgggaaggccuggcugcacgugugcgucaccggcgacgaccgcaacgccaccgccucguucaucuacgacgggcggcucguggacuccaucggcucguggucccagaacauccugcgcacccaggagagcgagugcgugugcaucaacggcacgugcaccgucgugaugaccgacggguccgcgucgggccgggccgacacccgcauccuguucaucaaggaggggaagaucgugcacaucagcccccucuccggcucggcccagcacaucgaggagugcuccugcuacccccgguacccggacguccgcugcaucugccgggacaacuggaagggcagcaaccgccccgugaucgacaucaacauggaggacuacuccaucgacucguccuacgugugcagcgggcuggucggcgacacgccccggaacgacgacuccucguccaacucgaacugccgcgaccccaacaacgagcgggggaacccgggcgugaaggggugggccuucgacaacggcgacgacguguggaugggccgcaccaucuccaaggaccugcggagcggguacgagaccuucaaggucaucggcgggugguccacccccaacucgaagucccaggugaaccgccaggucaucguggacaacaacaacuggagcggcuacuccgggaucuucucgguggagggcaagagcugcaucaaccggugcuucuacgucgagcucauccgcggccgcccccaggagacgcgggugugguggaccuccucguccaucguggucuucugcgggaccagcggcaccuacgggacgggcuccuggcccgacggggccaacaucaacuucaugccgaucuga

SEQ ID NO: 22528 - RNA, 1410 nt, Artificial Sequence
  derived and/or modified CDS sequence (AUadapt) from InfluenzaA__ADT78963__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacgacaccauccacgaccgcaucccgcaccggacgcugcugaugaacgagcucggcgugcccuuccaccuggggacccgccaggucugcguggcguggagcuccucguccugccacgacggcaaggccuggcugcacgugugcgucaccggggacgaccggaacgccaccgccucguucaucuacgacggccgccucguggacuccaucgggagcuggucccagaacauccugcggacgcaggagucggagugcgugugcaucaacgggaccugcaccgucgugaugaccgacggcuccgcgucggggcgcgccgacacgcggauccuguucaucaaggagggcaagaucgugcacaucagcccccucuccgggucggcccagcacgucgaggagugcuccugcuacccccgcuacccggacgugcggugcaucugccgcgacaacuggaagggcucgaaccggcccgugaucgacaucaacauggaggacuacuccaucgacagcuccuacgucugcucgggccuggugggggacacgccccgcaacgacgaccgguccucgaacuccaacugccgcgaccccaacaacgagcggggcaacccgggggugaagggcugggccuucgacaacgggaacgacgucuggaugggccgcaccaucagcaaggaccugcgguccggcuacgagaccuucaaggugaucgggggcuggucgacccccaacuccaagucgcaggucaaccgccaggugaucguggacaacaacaacugguccggguacagcggcaucuucuccgucgagggcaagucgugcaucaaccgcugcuucuacguggagcucauccggggccgccagcaggagacccgggugugguggaccucgaacuccaucgucguguucugcggcaccagcgggacguacggcaccggguccuggcccgacggcgccaacaucaacuucaugcccaucuga

SEQ ID NO: 22529 - RNA, 1410 nt, Artificial Sequence
  derived and/or modified CDS sequence (AUadapt) from InfluenzaA__ADT79001__NA
augaaccccaaccagaagaucaucaccaucggcucgaucucccugaccaucgccacgaucugcuuccucaugcagaucgccauccuggugaccaccgucacccugcacuucaagcaguacgagugcgacucgccggcgaacaaccaggugaugcccugcgagcccaucaucaucgagcgcaacaucacggagaucguguaccucaccaacaccaccaucgagaaggagaucugccccaagcuggucgaguaccggaacugguccaagccgcagugcaagaucacgggguucgcccccuucagcaaggacaacuccauccgccugucggccggcggggacaucugggugacccgggagcccuacguguccugcgaccccggcaagugcuaccaguucgcccucgggcagggcaccacccuggacaacaagcacagcaacgacacgauccacgaccgcaucccgcaccggacccugcucaugaacgagcugggcguccccuuccaccuggggacccgccaggugugcaucgccugguccucguccucgugccacgacggcaaggcguggcuccacgugugcgucaccggggacgacaagaacgccacggccuccuucaucuacgacggccggcugguggacagcaucggguccuggucgcagaacauccugcgcacccaggaguccgagugcgugugcaucaacgggaccugcaccgucgugaugacggacggcagcgccuccggcaaggcggacacccggauccucuucaucgaggagggcaagaucgugcacaucucgccccugucgggguccgcccagcacgucgaggagugcagcugcuacccccgcuacccgggcgugcggugcaucugccgcgacaacuggaagggcuccaaccggcccguggucgacaucaacgugaaggacuacucgaucgacuccagcuacgugugcuccgggcuggucggcgacacgccccgcaacaacgaccggucguccucguccuacugccgcaaccccaacaacgagcgggggaaccacggcgugaaggggugggccuucgacgacggcaacgacguguggaugggccgcaccaucagcaaggacucccggucgggguacgagaccuucaaggucaucggcgggugguccaccccgaacagcaagucccagaucaaccgccaggugaucgucgacucggacaaccgguccggcuacucggggaucuucagcguggagggcaaguccugcaucaaccgcugcuucuacguggagcucauccgcggccgggagcaggagacccgcgucugguggaccucgaacuccaucgugguguucugcgggacgagcggcaccuacgggaccggcuccuggcccgacggggccgacaucaaccugaugcccaucuga

SEQ ID NO: 22530 - RNA, 1410 nt, Artificial Sequence; identical to SEQ ID NO: 16520
  derived and/or modified CDS sequence (AUadapt) from InfluenzaA__ADT79021__NA

SEQ ID NO: 22531 - RNA, 1410 nt, Artificial Sequence
  derived and/or modified CDS sequence (AUadapt) from InfluenzaA__ADT79041__NA
augaaccccaaccagaagaucaucaccaucggcucggugucccugaccaucgccacggucugcuuccucaugcagaucgccauccuggugaccaccgugacccugcacuuccgccaguacgagugcgacucgccggcgaacaaccaggucaugcccugcgagcccaucaucaucgagcggaacaucacggagaucguguaccucaacaacaccaccaucgagaaggagaucugccccaagcugguggaguaccgcaacugguccaagccgcagugcaagaucaccggguucgcccccuucagcaaggacaacuccauccggcugucggccggcggggacaucugggucacgcgcgagcccuacguguccugcgaccccggcaagugcuaccaguucgcccucgggcagggcaccacccuggacaacaagcacucgaacgacaccauccacgaccggaucccgcaccgcacgcugcucaugaacgagcugggcgugcccuuccaccuggggacccggcaggucugcaucgccugguccagcuccucgugccacgacggcaaggcguggcuccacgugugcgugaccggggacgacaagaacgccaccgccuccuucaucuacgacggccgccuggucgacucgaucggguccuggagccagaacauccugcggacgcaggaguccgagugcgugugcaucaacgggaccugcaccguggucaugaccgacggcucggccuccggccgcgcggacacgaagauccucuucaucgaggagggcaagaucgugcacaucucgccccugagcggguccgcccagcacguggaggagugcucgugcuacccccgguacccgggcguccgcugcaucugccgggacaacuggaagggcuccaaccgccccgugguggacaucaacgucgaggacuacucgaucgacuccagcuacgugugcuccgggcuggugggcgacacgccccggaacaacgaccgcucguccaacucgaacugccggaaccccaacaacgagcgcgggaaccacggcgucaaggggugggccuucgacgacggcaacgacguguggaugggccggaccaucuccaaggaccuccgcagcggguacgagaccuucaaggucaucggcgggugguccaccccgaacucgaagucccagaucaaccgccaggugaucguggacucggacaaccgguccggcuacagcgggaucuucuccgucgagggcaagucgugcaucaaccgcugcuucuacguggagcugauccggggccgcgagcaggagacccgggugugguggaccucgaacuccaucgucguguucugcgggaccagcggcacguacgggaccggcuccuggcccgacggggccgacaucaaccugaugcccaucuga

SEQ ID NO: 22532 - RNA, 1410 nt, Artificial Sequence; identical to SEQ ID NO: 18162
  derived and/or modified CDS sequence (AUadapt) from InfluenzaA__ADT79121__NA

SEQ ID NO: 22533 - RNA, 1410 nt, Artificial Sequence
  derived and/or modified CDS sequence (AUadapt) from InfluenzaA__ADT79131__NA
augaaccccaaccagaagaucaucaccaucggcucggugucccugaccaucgccacggucugcuuccucaugcagaucgccauccuggcgaccaccgugacccugcacuucaagcagcacgagugcgacucgccggccuccaaccaggugaugcccugcgagcccaucaucaucgagcgcaacaucacggagaucgucuaccucaacaacaccaccaucgagaaggagaucugccccgaggugguggaguaccggaacuggagcaagccgcagugccagaucaccggguucgcccccuucuccaaggacaacucgauccgccuguccgccggcggggacaucugggucacgcgggagcccuacgugucgugcgaccccggcaagugcuaccaguucgcccuggggcagggcaccacccucgacaacaagcacuccaacggcaccauccacgaccgcaucccgcaccggacgcugcugaugaacgagcucggggugcccuuccaccugggcaccaagcaggucugcguggcguggagcuccucguccugccacgacgggaaggccuggcugcacgugugcgucaccggcgacgaccgcaacgccaccgccagcuucaucuacgacgggcggcucgaggacuccaucggcucguggucccagaacauccugcgcacgcaggagucggagugcgugugcaucaacgggaccugcaccguggucaugaccgacggcuccgcgagcggccgggccgacacgcgcauccuguucaucaaggaggggaagaucgugcacaucucgccccucuccggcagcgcccagcacaucgaggagugcuccugcuacccccgguacccggacgugcgcugcaucugccgggacaacuggaagggcucgaaccgccccguccuggacaucuccauggaggacuacucgaucgacuccagcuacgugugcuccgggcuggugggcgacacgccccggaacgacgacucguccucgaacuccaacugccgcgaccccaacaacgagcgggggaacccgggcgucaaggggugggccuucgacaacggcgacgacguguggaugggccgcaccaucagcaaggaccuccgguccggguacgagaccuucaaggugaucggcggguggucgacccccaacuccaagagccaggucaaccgccaggugaucgucgacaacaacaacugguccggcuacucggggaucuucucgguggagggcaaguccugcaucaaccggugcuucuacguggagcugauccgcggccgcagccaggagacccgggucugguggaccuccaacucgaucgugguguucugcgggaccuccggcacguacgggaccggcagcuggcccgacggggccaacaucaacuucaugcccaucuga

SEQ ID NO: 22534 - RNA, 1410 nt, Artificial Sequence; identical to SEQ ID NO: 16318
  derived and/or modified CDS sequence (AUadapt) from InfluenzaA__ADT79234__NA

SEQ ID NO: 22535 - RNA, 1410 nt, Artificial Sequence; identical to SEQ ID NO: 16274
  derived and/or modified CDS sequence (AUadapt) from InfluenzaA__ADT79244__NA

SEQ ID NO: 22536 - RNA, 1410 nt, Artificial Sequence
  derived and/or modified CDS sequence (AUadapt) from InfluenzaA__ADU25480__NA
augaaccccaaccagaagaucaucaucaucucguccaucugccugaucaacggcaucaccagccucauccugcagaucgggaacaucaucuccaucuggaucagccacuccauccagaucggcaaccagaaccagaccgagacgugcagccagaacaucaucaccuacgagaacaacaccugggugaaccagaccuacgucaacaucuccaacaacaacuucguggccgagcaggccguggucagcaugaagcuggcgggguccagcccgcucugccccguguccggcugggccaucuacagcaaggacaacuccgugcgcaucgggucgaagggcgacgucuucgugauccgggagcccuucaucuccugcagccaccuggagugccgcacguucuuccugacccagggcgcccuccugaacgacaagcacuccaacgggaccaucaaggaccggagccccuaccgcacccugauguccugcccgaucggcgaggugcccagccccuacaacagccgguucgaguccgucgccuggagcgccuccgcgugccacgacgggacgagcuggcucaccaucggcaucuccgggcccgacaacggcgccguggccgugcugaaguacaacgacaucaucaccgacaccaucaagucguggcgcaacaacauccugcggacgcaggaguccgagugcgucugcgugaacggcagcugcuucaccgugaugaccgacgggccguccaacggccaggccagcuacaagaucuucaagaucgagaaggggaaggucgugaaguccguggagcucaacgcgcccaacuaccacuacgaggagugcagcugcuaccccgacuccggcgagaucaucugcgucugccgcgacaacuggcacggcagcaaccggcccuggguguccuucaaccagaaccuggaguaccagaucggguacaucugcagcggcauccugggggacaacccgcgccccaacgaccggaccggcuccugcgggcccgugagccucaacggcgccaacggcgucaagggguucuccuucaaguacggcaacgggguguggaucggccgcaccaagucgagcuccagccgguccggguucgagaugaucugggaccccaacggcuggacggagaccgacaacaacuuccuggugaagcaggacaucgucggcaugaccgacuggagcggguacuccggcagcuucgugcagcacccggagcugacggggaugaacugcaugcgccccugcuucugggucgagcucauccggggccgccccaaggagaacaccaucuggaccuccgggagcuccaucagcuucugcggcgugaacuccgacaccguggacuggagcuggcccgacggcgccgagcugccguucacgaucgacaaguga

SEQ ID NO: 22537 - RNA, 1410 nt, Artificial Sequence; identical to SEQ ID NO: 16318
  derived and/or modified CDS sequence (AUadapt) from InfluenzaA__ADU59780__NA

SEQ ID NO: 22538 - RNA, 1410 nt, Artificial Sequence
  derived and/or modified CDS sequence (AUadapt) from InfluenzaA__ADU59789__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacgucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22539 - RNA, 1410 nt, Artificial Sequence; identical to SEQ ID NO: 16318
  derived and/or modified CDS sequence (AUadapt) from InfluenzaA__ADU59829__NA

SEQ ID NO: 22540 - RNA, 1410 nt, Artificial Sequence
  derived and/or modified CDS sequence (AUadapt) from InfluenzaA__ADU59838__NA
augaaccccaaccagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggucgugcuucacggugaugaccgacggcccguccgacggccaggccagcuacaagaucuuccgcaucgagaaggggaagaucgucaaguccguggagaugaacgcccccaacuaccacuucgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagucgaucagcucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgacugguccuggcccgacggggccgagcugccguucaccaucgacaaguga

SEQ ID NO: 22541 - RNA, 1410 nt, Artificial Sequence; identical to SEQ ID NO: 20491
  derived and/or modified CDS sequence (AUadapt) from InfluenzaA__ADU59847__NA

SEQ ID NO: 22542 - RNA, 1410 nt, Artificial Sequence; identical to SEQ ID NO: 16318
  derived and/or modified CDS sequence (AUadapt) from InfluenzaA__ADU59907__NA

SEQ ID NO: 22543 - RNA, 1410 nt, Artificial Sequence; identical to SEQ ID NO: 16318
  derived and/or modified CDS sequence (AUadapt) from InfluenzaA__ADU59917__NA

SEQ ID NO: 22544 - RNA, 1410 nt, Artificial Sequence; identical to SEQ ID NO: 16318
  derived and/or modified CDS sequence (AUadapt) from InfluenzaA__ADU59920__NA

SEQ ID NO: 22545 - RNA, 1410 nt, Artificial Sequence; identical to SEQ ID NO: 16318
  derived and/or modified CDS sequence (AUadapt) from InfluenzaA__ADU59941__NA

SEQ ID NO: 22546 - RNA, 1410 nt, Artificial Sequence
  derived and/or modified CDS sequence (AUadapt) from InfluenzaA__ADU76311__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccaagcugccguucacgaucgacaaguga

SEQ ID NO: 22547 - RNA, 1410 nt, Artificial Sequence
  derived and/or modified CDS sequence (AUadapt) from InfluenzaA__ADU76313__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccaagcugccguucacgaucgacaaguga

SEQ ID NO: 22548 - RNA, 1410 nt, Artificial Sequence; identical to SEQ ID NO: 22547
  derived and/or modified CDS sequence (AUadapt) from InfluenzaA__ADU76314__NA

SEQ ID NO: 22549 - RNA, 1410 nt, Artificial Sequence; identical to SEQ ID NO: 22547
  derived and/or modified CDS sequence (AUadapt) from InfluenzaA__ADU76315__NA

SEQ ID NO: 22550 - RNA, 1410 nt, Artificial Sequence; identical to SEQ ID NO: 22547
  derived and/or modified CDS sequence (AUadapt) from InfluenzaA__ADU76316__NA

SEQ ID NO: 22551 - RNA, 1410 nt, Artificial Sequence
  derived and/or modified CDS sequence (AUadapt) from InfluenzaA__ADU76317__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaccagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 22552 - RNA, 1410 nt, Artificial Sequence
  derived and/or modified CDS sequence (AUadapt) from InfluenzaA__ADU76318__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccacaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22553 - RNA, 1410 nt, Artificial Sequence; identical to SEQ ID NO: 20383
  derived and/or modified CDS sequence (AUadapt) from InfluenzaA__ADU76319__NA

SEQ ID NO: 22554 - RNA, 1410 nt, Artificial Sequence; identical to SEQ ID NO: 16318
  derived and/or modified CDS sequence (AUadapt) from InfluenzaA__ADU76320__NA

SEQ ID NO: 22555 - RNA, 1410 nt, Artificial Sequence; identical to SEQ ID NO: 16318
  derived and/or modified CDS sequence (AUadapt) from InfluenzaA__ADU76321__NA

SEQ ID NO: 22556 - RNA, 1410 nt, Artificial Sequence
  derived and/or modified CDS sequence (AUadapt) from InfluenzaA__ADU76322__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccaucaucagcuucugcggcgucaacuccgacaccgugggguggagcuggcccgacggcgccgagcugccguucacgaucgacaaguga

SEQ ID NO: 22557 - RNA, 1410 nt, Artificial Sequence; identical to SEQ ID NO: 22546
  derived and/or modified CDS sequence (AUadapt) from InfluenzaA__ADU76323__NA

SEQ ID NO: 22558 - RNA, 1410 nt, Artificial Sequence; identical to SEQ ID NO: 22547
  derived and/or modified CDS sequence (AUadapt) from InfluenzaA__ADU76324__NA

SEQ ID NO: 22559 - RNA, 1410 nt, Artificial Sequence; identical to SEQ ID NO: 22546
  derived and/or modified CDS sequence (AUadapt) from InfluenzaA__ADU76325__NA

SEQ ID NO: 22560 - RNA, 1410 nt, Artificial Sequence; identical to SEQ ID NO: 22547
  derived and/or modified CDS sequence (AUadapt) from InfluenzaA__ADU76326__NA

SEQ ID NO: 22561 - RNA, 1410 nt, Artificial Sequence; identical to SEQ ID NO: 22547
  derived and/or modified CDS sequence (AUadapt) from InfluenzaA__ADU76327__NA

SEQ ID NO: 22562 - RNA, 1410 nt, Artificial Sequence; identical to SEQ ID NO: 22546
  derived and/or modified CDS sequence (AUadapt) from InfluenzaA__ADU76328__NA

SEQ ID NO: 22563 - RNA, 1410 nt, Artificial Sequence; identical to SEQ ID NO: 22547
  derived and/or modified CDS sequence (AUadapt) from InfluenzaA__ADU76329__NA

SEQ ID NO: 22564 - RNA, 1410 nt, Artificial Sequence; identical to SEQ ID NO: 22547
  derived and/or modified CDS sequence (AUadapt) from InfluenzaA__ADU76330__NA

SEQ ID NO: 22565 - RNA, 1410 nt, Artificial Sequence; identical to SEQ ID NO: 22547
  derived and/or modified CDS sequence (AUadapt) from InfluenzaA__ADU76331__NA

SEQ ID NO: 22566 - RNA, 1410 nt, Artificial Sequence; identical to SEQ ID NO: 22547
  derived and/or modified CDS sequence (AUadapt) from InfluenzaA__ADU76332__NA

SEQ ID NO: 22567 - RNA, 1410 nt, Artificial Sequence; identical to SEQ ID NO: 16318
  derived and/or modified CDS sequence (AUadapt) from InfluenzaA__ADU76333__NA

SEQ ID NO: 22568 - RNA, 1410 nt, Artificial Sequence; identical to SEQ ID NO: 16318
  derived and/or modified CDS sequence (AUadapt) from InfluenzaA__ADU76334__NA

SEQ ID NO: 22569 - RNA, 1410 nt, Artificial Sequence; identical to SEQ ID NO: 16318
  derived and/or modified CDS sequence (AUadapt) from InfluenzaA__ADU76335__NA

SEQ ID NO: 22570 - RNA, 1410 nt, Artificial Sequence; identical to SEQ ID NO: 22547
  derived and/or modified CDS sequence (AUadapt) from InfluenzaA__ADU76336__NA

SEQ ID NO: 22571 - RNA, 1410 nt, Artificial Sequence; identical to SEQ ID NO: 19907
  derived and/or modified CDS sequence (AUadapt) from InfluenzaA__ADU76337__NA

SEQ ID NO: 22572 - RNA, 1410 nt, Artificial Sequence; identical to SEQ ID NO: 21042
  derived and/or modified CDS sequence (AUadapt) from InfluenzaA__ADU76338__NA

SEQ ID NO: 22573 - RNA, 1410 nt, Artificial Sequence; identical to SEQ ID NO: 22546
  derived and/or modified CDS sequence (AUadapt) from InfluenzaA__ADU76339__NA

SEQ ID NO: 22574 - RNA, 1410 nt, Artificial Sequence; identical to SEQ ID NO: 16318
  derived and/or modified CDS sequence (AUadapt) from InfluenzaA__ADU76341__NA

SEQ ID NO: 22575 - RNA, 1410 nt, Artificial Sequence; identical to SEQ ID NO: 16318
  derived and/or modified CDS sequence (AUadapt) from InfluenzaA__ADU76342__NA

SEQ ID NO: 22576 - RNA, 1410 nt, Artificial Sequence; identical to SEQ ID NO: 16318
  derived and/or modified CDS sequence (AUadapt) from InfluenzaA__ADU76343__NA

SEQ ID NO: 22577 - RNA, 1410 nt, Artificial Sequence; identical to SEQ ID NO: 22547
  derived and/or modified CDS sequence (AUadapt) from InfluenzaA__ADU76344__NA

SEQ ID NO: 22578 - RNA, 1410 nt, Artificial Sequence; identical to SEQ ID NO: 22547
  derived and/or modified CDS sequence (AUadapt) from InfluenzaA__ADU76345__NA

SEQ ID NO: 22579 - RNA, 1410 nt, Artificial Sequence
  derived and/or modified CDS sequence (AUadapt) from InfluenzaA__ADU76346__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccgagaccgacaacaacuucucgaucaagcaggacaucgugggcaucaacgagugguccggguacagcggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggccgagcugccguucacgaucgacaaguga

SEQ ID NO: 22580 - RNA, 1410 nt, Artificial Sequence; identical to SEQ ID NO: 19907
  derived and/or modified CDS sequence (AUadapt) from InfluenzaA__ADU76347__NA

SEQ ID NO: 22581 - RNA, 1410 nt, Artificial Sequence
  derived and/or modified CDS sequence (AUadapt) from InfluenzaA__ADV17285__NA
augaaccccaaccaggagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuuccgcuacggcaacggggucuggaucggccggaccaagagcaucagcucccgcaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 22582 - RNA, 1410 nt, Artificial Sequence; identical to SEQ ID NO: 16318
  derived and/or modified CDS sequence (AUadapt) from InfluenzaA__ADV17295__NA

SEQ ID NO: 22583 - RNA, 1410 nt, Artificial Sequence
  derived and/or modified CDS sequence (AUadapt) from InfluenzaA__ADV17305__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcuccagccuggagugccgcaccuucuuccugacccagggcgcccuccugaacgacaagcacuccaacgggaccaucaaggaccggagccccuaccgcacgcugauguccugccccaucggcgaggucccgagccccuacaacucgcgguucgaguccguggccuggagcgcguccgccugccacgacgggaucaacuggcucaccaucggcaucagcggcuccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggccccuccgacggccaggccagcuacaagaucuuccgcaucgagaaggggaagaucgugaaguccgucgagaugaacgcccccaacuaccacuacgaggagugcucgugcuacccggacuccagcgagaucacgugcgugugccgggacaacuggcacggcuccaaccgccccugggugagcuucaaccagaaccucgaguaccagaucggguacaucugcuccggcaucuucggggacaacccccggcccaacgacaagaccggcagcugcggcccggucuccagcaacggggccaacggcgugaagggguucagcuucaaguacggcaacgggguguggaucggccgcaccaaguccaucucgucccggaacggcuucgagaugaucugggaccccaacggguggaccggcaccgacaacaacuucagcaucaagcaggacaucgucgggaucaacgagugguccggcuacagcggguccuucgugcagcaccccgagcugacgggccuggacugcauccgccccugcuucuggguggagcucauccggggccgcccgaaggagaacaccaucuggaccagcggguccagcaucuccuucugcggcgucaacagcgacaccguggggugguccuggcccgacggcgccgagcugcccuucacgaucgacaaguga

SEQ ID NO: 22584 - RNA, 1410 nt, Artificial Sequence; identical to SEQ ID NO: 16318
  derived and/or modified CDS sequence (AUadapt) from InfluenzaA__ADV17315__NA

SEQ ID NO: 22585 - RNA, 1410 nt, Artificial Sequence; identical to SEQ ID NO: 20571
  derived and/or modified CDS sequence (AUadapt) from InfluenzaA__ADV17325__NA

SEQ ID NO: 22586 - RNA, 1410 nt, Artificial Sequence
  derived and/or modified CDS sequence (AUadapt) from InfluenzaA__ADV17335__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcguguucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagugcccguucacgaucgacaaguga

SEQ ID NO: 22587 - RNA, 1410 nt, Artificial Sequence; identical to SEQ ID NO: 16318
  derived and/or modified CDS sequence (AUadapt) from InfluenzaA__ADV19022__NA

SEQ ID NO: 22588 - RNA, 1410 nt, Artificial Sequence
  derived and/or modified CDS sequence (AUadapt) from InfluenzaA__ADV41679__NA
augaaccccaaccagaagaucaucaccaucggcucggugugcaugaccaucgggauggccaaccugauccuccagaucggcaacaucaucuccaucuggaucagccacuccauccagcugcgcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcauccggaucggcuccaagggcgacguguucgugauccgcgagcccuucaucagcugcagcccccuggagugccggaccuucuuccugacccagggggcccuccugaacgacaagcacuccaacggcaccaucaaggaccgcucccccuaccggacgcugaugucgugcccgaucggggagguccccucccccuacaacagccgcuucgagagcguggccugguccgcgagcgccugccacgacggcaucaacuggcucaccaucgggaucuccggccccgacaacggcgccguggccguccugaaguacaacgggaucaucaccgacaccaucaagagcuggcggaacaacauccugcgcacgcaggaguccgagugcgcgugcgugaacggcucgugcuucaccgugaugaccgacgggccguccgacggccaggccagcuacaagaucuuccggaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucucguucaaccagaaccucgaguaccagaucggcuacaucugcuccgggaucuucggcgacaacccgcgccccaacgacaagaccgggagcugcggccccguguccagcaacggcgccaacggggugaagggcuucuccuucaaguacgggaacggcgucuggaucgggcggaccaagagcaucagcucccgcaacggcuucgagaugaucugggaccccaacggcuggaccgggaccgacaacaacuucucgaucaagcaggacaucgugggcaucaacgagugguccggguacagcggcuccuucgugcagcacccggagcugacggggcuggacugcauccggcccugcuucugggucgagcucauccgcggccggcccaaggagaacaccaucuggaccagcggcuccagcaucuccuucugcggggugaacagcgacaccgucggcugguccuggcccgacggggccgagcugccguucacgaucgacaaguga

SEQ ID NO: 22589 - RNA, 1410 nt, Artificial Sequence
  derived and/or modified CDS sequence (AUadapt) from InfluenzaA__ADV76582__NA
augaaccccaaccagaagaucaucaccaucggcucggugucccugaccaucagcacggucugcuucuucaugcagaucgccauccucaucaccaccgugacccugcacuucaagcaguacgaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggugaucgucgacaagggcaaccgguccggguacucgggcaucuucuccguggagggcaagagcugcaucaaccgcugcuucuacguggagcucauccgggggcgcaaggaggagaccgagguccuguggaccucgaacuccaucgugguguucugcggcacgagcgggaccuacggcaccggguccuggccggacggcgccgaccugaaccucaugcccaucuga

SEQ ID NO: 22590 - RNA, 1410 nt, Artificial Sequence; identical to SEQ ID NO: 19001
  derived and/or modified CDS sequence (AUadapt) from InfluenzaA__ADV76590__NA

SEQ ID NO: 22591 - RNA, 1410 nt, Artificial Sequence; identical to SEQ ID NO: 19001
  derived and/or modified CDS sequence (AUadapt) from InfluenzaA__ADV76601__NA

SEQ ID NO: 22592 - RNA, 1410 nt, Artificial Sequence; identical to SEQ ID NO: 19994
  derived and/or modified CDS sequence (AUadapt) from InfluenzaA__ADV76612__NA

SEQ ID NO: 22593 - RNA, 1410 nt, Artificial Sequence; identical to SEQ ID NO: 19001
  derived and/or modified CDS sequence (AUadapt) from InfluenzaA__ADV76623__NA

SEQ ID NO: 22594 - RNA, 1410 nt, Artificial Sequence; identical to SEQ ID NO: 19001
  derived and/or modified CDS sequence (AUadapt) from InfluenzaA__ADV76634__NA

SEQ ID NO: 22595 - RNA, 1410 nt, Artificial Sequence; identical to SEQ ID NO: 21868
  derived and/or modified CDS sequence (AUadapt) from InfluenzaA__ADV76645__NA

SEQ ID NO: 22596 - RNA, 1410 nt, Artificial Sequence
  derived and/or modified CDS sequence (AUadapt) from InfluenzaA__ADV76667__NA
augaaccccaaccagaagaucaucaccaucggcucggugucccugaccaucgccacggucugcuuccucaugcagaucgccauccuggugaccaccgugacccugcacuucaagcaguacgagugcgacucgccggcguccaaccaggucaugcccugcgagcccaucaucaucgagcgcaacaucacggagaucguguaccucaacaacaccaccaucgagaaggagaucugccccaagguggucgaguaccggaacuggagcaagccgcagugccagaucaccggguucgcccccuucuccaaggacaacucgauccgccuguccgccggcggggacaucugggugacgcgggagcccuacgugagcugcgaccacggcaagugcuaccaguucgcccuggggcagggcaccacccucgacaacaagcacuccaacgacaccauccacgaccgcaucccccaccggacgcugcugaugaacgagcucggcgucccguuccaccuggggacccgccaggugugcaucgccuggucguccucguccugccacgacggcaaggcguggcugcacgugugcaucaccggggacgacaagaacgccaccgccagcuucaucuacgacggccggcucgucgacuccaucgggucguggucccagaacauccugcgcacgcaggagagcgagugcgugugcaucaacgggaccugcaccguggucaugaccgacggcuccgccucgggccgggcggacacgcgcauccuguucaucgaggagggcaagaucgugcacaucucgccccucuccgggagcgcccagcacguggaggagugcuccugcuacccccgguaccccggcguccgcugcaucugccgggacaacuggaagggcucgaaccgcccggugguggacaucaacauggaggacuacuccaucgacagcuccuacgucugcucggggcuggugggcgacacgccccggaacgacgaccgcuccucgaacuccaagagccggaaccccaacaacgagcgcgggaaccagggcgugaaggggugggccuucgacaacggcgacgacgucuggaugggccggaccaucucccgcgaccugcggucgggguacgagaccuucaaggugaucggcgggugguccacccccaacagcaagucccagaucaaccgccaggucaucguggacucggacaaccgcuccggcuacucggggaucuucagcguggagggcaaguccugcaucaaccggugcuucuacgucgagcucauccgcggccggaagcaggagacccgcgugugguggaccucgaacuccaucguggucuucugcgggaccagcggcacguacgggaccggcuccuggccggacggggccaacaucaacuucaugcccaucuga

SEQ ID NO: 22597 - RNA, 1410 nt, Artificial Sequence; identical to SEQ ID NO: 21870
  derived and/or modified CDS sequence (AUadapt) from InfluenzaA__ADV76676__NA

SEQ ID NO: 22598 - RNA, 1410 nt, Artificial Sequence; identical to SEQ ID NO: 21011
  derived and/or modified CDS sequence (AUadapt) from InfluenzaA__ADV76697__NA

SEQ ID NO: 22599 - RNA, 1410 nt, Artificial Sequence
  derived and/or modified CDS sequence (AUadapt) from InfluenzaA__ADV76708__NA
augaaccccaaccagaagaucaucaccaucggcucggugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacaucacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 22600 - RNA, 1410 nt, Artificial Sequence
  derived and/or modified CDS sequence (AUadapt) from InfluenzaA__ADV76719__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaugaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 22601 - RNA, 1410 nt, Artificial Sequence
  derived and/or modified CDS sequence (AUadapt) from InfluenzaA__ADV76730__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagacccugcgcacgcaggagucggagugcgugugcaucaacgggaccugcaccguggucaugaccgacggguccgccagcggcaaggccgacacgaagauccucuucaucgaggagggcaagaucgugcacaccucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaaggacgacuccagcuccucgucccacugccucgaccccaacaacgaggagggcggccacggggucaagggcugggccuucgacgacgggaacgacguguggaugggccgcaccaucagcgagaagucccggcugggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcucauccgcgggcggaaggaggagaccgaggugcuguggaccuccaacucgaucgucguguucugcggcacguccgggaccuacggcaccgggagcuggccggacggcgccgacaucaaccugaugcccaucuga

SEQ ID NO: 22602 - RNA, 1410 nt, Artificial Sequence
  derived and/or modified CDS sequence (AUadapt) from InfluenzaA__ADV78132__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccuggcugaaccagaccuacgugaacaucagcaacacgaacuucgccgcgggccaguccguggucagcgugaagcucgccgggaacuccucgcugugcccgguguccggcugggccaucuacagcaaggacaacuccauccgcaucggcagcaagggggacgucuucgugauccgggagcccuucaucuccugcagccccuccgagugccgcaccuucuuccugacccagggcgcccuccugaacgacaagcacagcaacgggaccaucaaggaccggucccccuaccgcacgcugaugagcugcccgaucggcgaggugcccucgcccuacaacucccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccaucaugaccgacggcccguccgacggccaggccagcuacaagaucuuccgcaucgagaaggggaagaucgugaaguccgugggcaugaacgcccccaacuaccacuacgaggagugcucgugcuaccccgacuccagcgagaucacgugcgucugccgggacaacuggcacggguccaaccgccccugggugagcuucaaccagaaccucgaguaccagaucggcuacaucugcuccgggaucuucggcgacaacccgcggcccaacgacaagaccggcagcugcgggcccguguccagcaacggcgccaacggggucaagggcuucagcuucaaguacgggaacggcguguggaucggccgcaccaaguccaucucgucccggaagggguucgagaugaucugggaccccaacggcuggaccgggaccgacaacaacuucagcaucaagcaggacaucgugggcaucaacgagugguccggguacagcggcuccuucguccagcacccggagcugacgggccuggacugcauccgccccugcuucuggguggagcucauccgggggcgccccaaggagaacaccaucugggccagcggcuccagcaucuccuucugcggggugaacagcgacaccgucggcugguccuggcccgacggcgcggagcugccguucaucaucgacaaguga

SEQ ID NO: 22603 - RNA, 1413 nt, Artificial Sequence
  derived and/or modified CDS sequence (AUadapt) from InfluenzaA__ADW09104__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccaacaacaaggccgccucguacaagaucuucaagaucgagaaggggaaggugaccaaguccaucgagcucaacgcccccaacuucuacuacgaggagugcagcugcuacccggacaccggcaucgucaugugcgugugccgggacaacuggcacggguccaaccgccccugggugagcuucaaccagaaccuggacuaccagaucggcuacaucugcuccggcgucuucggggacaacccccggcccgaggacggcgaggggucgugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacugguccggguacagcggcagcuucgugcagcaccccgagcucacgggccuggacugcauccggcccugcuucugggucgagcuggugcgcgggcucccgcgggagaacaccaccaucuggaccuccggcucguccaucagcuucugcggggucaacuccgacacggccaacuggagcuggcccgacggcgccgagcugcccuucaccaucgacaaguga

SEQ ID NO: 22604 - RNA, 1413 nt, Artificial Sequence; identical to SEQ ID NO: 19863
  derived and/or modified CDS sequence (AUadapt) from InfluenzaA__ADW09114__NA

SEQ ID NO: 22605 - RNA, 1413 nt, Artificial Sequence
  derived and/or modified CDS sequence (AUadapt) from InfluenzaA__ADW09123__NA
augaaccccaaccagaagaucaucaccaucggcucgaucuccaucgccaucgggaucaccagccugaugcuccagaucggcaacaucaucuccaucugggccucgcacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccucgcugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcggacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22606 - RNA, 1413 nt, Artificial Sequence
  derived and/or modified CDS sequence (AUadapt) from InfluenzaA__ADW09156__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 22607 - RNA, 1413 nt, Artificial Sequence
  derived and/or modified CDS sequence (AUadapt) from InfluenzaA__ADW09167__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 22608 - RNA, 1413 nt, Artificial Sequence; identical to SEQ ID NO: 19863
  derived and/or modified CDS sequence (AUadapt) from InfluenzaA__ADW09178__NA

SEQ ID NO: 22609 - RNA, 1413 nt, Artificial Sequence; identical to SEQ ID NO: 19863
  derived and/or modified CDS sequence (AUadapt) from InfluenzaA__ADW09189__NA

SEQ ID NO: 22610 - RNA, 1413 nt, Artificial Sequence; identical to SEQ ID NO: 22607
  derived and/or modified CDS sequence (AUadapt) from InfluenzaA__ADW09211__NA

SEQ ID NO: 22611 - RNA, 1413 nt, Artificial Sequence
  derived and/or modified CDS sequence (AUadapt) from InfluenzaA__ADW09222__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggucggccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacagcgugaccguggacggcgcggacggggucaagggcuucuccuacaaguacggcaacgggguguggaucggccgcaccaagagcaaccggcugcgcaagggguucgagaugaucugggacccgaacggcuggacgaacaccgacuccgacuucucggugaagcaggacgucguggccaucaccgacuggagcggguacuccggcagcuucgugcagcaccccgagcucacgggccuggacugcauccggcccugcuucugggucgagcuggugcgcgggcucccccgggagaacaccaccaucuggaccuccggcucguccaucagcuucugcggggucaacuccgacacggccaacuggagcuggccggacggcgccgagcugcccuucaccaucgacaaguga

SEQ ID NO: 22612 - RNA, 1413 nt, Artificial Sequence
  derived and/or modified CDS sequence (AUadapt) from InfluenzaA__ADW09233__NA
augaaccccaaccagaagaucaucaccaucggcucgaucuccaucgccaucgggaccaucagccugaugcuccagaucggcaacaucaucuccaucugggccucgcacuccauccagacggggagccagaacaacaccggcaucugcaaccagcgcaucaucaccuacgagaacuccaccugggugaaccacacguacgucaacaucaacaacaccaacgugguggcgggggaggacaagaccagcgucacccuggccggcaacuccucgcugugcuccaucagcggcugggccaucuacacgaaggacaacuccauccggaucgggucgaagggcgacguguucgugauccgcgagccguucaucuccugcagccaccucgagugccggaccuucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucacgaucgggaucucgggccccgacaacggggcgguggccguccugaaguacaacggcaucaucaccggcaccaucaaguccuggaagaagcagauccugcgcacccaggagagcgagugcgugugcaugaacggguccugcuucacgaucaugaccgacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugacgguggacggcgcgaacggggucaagggcuucagcuacaaguacggcaacgggguguggaucggccgcaccaaguccaaccggcugcgcaagggguucgagaugaucugggaccccaacggcuggaccaacaccgacucggacuucuccgugaagcaggacgucguggccaucacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22613 - RNA, 1413 nt, Artificial Sequence; identical to SEQ ID NO: 22606
  derived and/or modified CDS sequence (AUadapt) from InfluenzaA__ADW09244__NA

SEQ ID NO: 22614 - RNA, 1413 nt, Artificial Sequence; identical to SEQ ID NO: 22606
  derived and/or modified CDS sequence (AUadapt) from InfluenzaA__ADW09255__NA

SEQ ID NO: 22615 - RNA, 1413 nt, Artificial Sequence; identical to SEQ ID NO: 22606
  derived and/or modified CDS sequence (AUadapt) from InfluenzaA__ADW09266__NA

SEQ ID NO: 22616 - RNA, 1413 nt, Artificial Sequence; identical to SEQ ID NO: 22606
  derived and/or modified CDS sequence (AUadapt) from InfluenzaA__ADW09277__NA

SEQ ID NO: 22617 - RNA, 1413 nt, Artificial Sequence; identical to SEQ ID NO: 19863
  derived and/or modified CDS sequence (AUadapt) from InfluenzaA__ADW09288__NA

SEQ ID NO: 22618 - RNA, 1413 nt, Artificial Sequence; identical to SEQ ID NO: 22607
  derived and/or modified CDS sequence (AUadapt) from InfluenzaA__ADW09299__NA

SEQ ID NO: 22619 - RNA, 1413 nt, Artificial Sequence; identical to SEQ ID NO: 19863
  derived and/or modified CDS sequence (AUadapt) from InfluenzaA__ADW09310__NA

SEQ ID NO: 22620 - RNA, 1413 nt, Artificial Sequence; identical to SEQ ID NO: 19863
  derived and/or modified CDS sequence (AUadapt) from InfluenzaA__ADW09330__NA

SEQ ID NO: 22621 - RNA, 1413 nt, Artificial Sequence; identical to SEQ ID NO: 22606
  derived and/or modified CDS sequence (AUadapt) from InfluenzaA__ADW10475__NA

SEQ ID NO: 22622 - RNA, 1413 nt, Artificial Sequence; identical to SEQ ID NO: 22607
  derived and/or modified CDS sequence (AUadapt) from InfluenzaA__ADW10486__NA

SEQ ID NO: 22623 - RNA, 1413 nt, Artificial Sequence; identical to SEQ ID NO: 19863
  derived and/or modified CDS sequence (AUadapt) from InfluenzaA__ADW10497__NA

SEQ ID NO: 22624 - RNA, 1413 nt, Artificial Sequence
  derived and/or modified CDS sequence (AUadapt) from InfluenzaA__ADW10508__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccuggucaacgacaagcacuccaacggcaccgugaaggaccgcagccccuaccgggcccucauguccugcccccugggggaggcgcccagcccguacaacucgaaguucgaguccguggccuggagcgccuccgccugccacgacggcaugggcuggcugaccaucgggaucagcggccccgacaacggggcggucgccgugcucaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggucaccaagagcaucgagcugaacgcccccaacuucuacuacgaggagugcuccugcuacccggacaccggcaucgugaugugcgugugccgggacaacuggcacgggucgaaccgccccugggucuccuucaaccagaaccucgacuaccagaucggcuacaucugcagcggcguguucggggacaacccccggcccgaggacggcgagggguccugcaacccggugaccgucaacggcgcggacggggugaagggcuucagcuacaaguacggcaacgggguguggaucggccgcacgaaguccaaccggcugcgcaagggguucgagaugaucugggaccccaacggcuggaccaacaccgacucggacuucuccgucaagcaggacgugguggccaucaccgacuggagcggguacagcggcuccuucguccagcaccccgagcugacgggccucgacugcauccggcccugcuucuggguggagcugguccgcgggcugccgcgggagaacaccaccaucuggaccucgggcuccagcaucuccuucugcggggugaacagcgacacggccaacugguccuggcccgacggcgccgagcuccccuucaccaucgacaaguga

SEQ ID NO: 22625 - RNA, 1413 nt, Artificial Sequence; identical to SEQ ID NO: 19863
  derived and/or modified CDS sequence (AUadapt) from InfluenzaA__ADW10519__NA

SEQ ID NO: 22626 - RNA, 1413 nt, Artificial Sequence; identical to SEQ ID NO: 19863
  derived and/or modified CDS sequence (AUadapt) from InfluenzaA__ADW10530__NA

SEQ ID NO: 22627 - RNA, 1413 nt, Artificial Sequence
  derived and/or modified CDS sequence (AUadapt) from InfluenzaA__ADW10541__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcauggacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 22628 - RNA, 1413 nt, Artificial Sequence
  derived and/or modified CDS sequence (AUadapt) from InfluenzaA__ADW10552__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccgacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 22629 - RNA, 1413 nt, Artificial Sequence; identical to SEQ ID NO: 22339
  derived and/or modified CDS sequence (AUadapt) from InfluenzaA__ADW10563__NA

SEQ ID NO: 22630 - RNA, 1413 nt, Artificial Sequence; identical to SEQ ID NO: 19863
  derived and/or modified CDS sequence (AUadapt) from InfluenzaA__ADW10574__NA

SEQ ID NO: 22631 - RNA, 1413 nt, Artificial Sequence
  derived and/or modified CDS sequence (AUadapt) from InfluenzaA__ADW10585__NA
augaaccccaaccagaagaucaucaccaucggcucgaucuccaucgccaucgggaucaucagccugaugcuccagaucggcuccaucaucagcaucugggccucccacucgauccagaccgggucccagaacaacacgggcaucugcaaccagcgcaucaucaccuacgagaacagcaccugggugaaccacaccuacgucaacaucaacaacacgaacgugguggcgggggaggacaagaaguccgucacccuggccggcaacagcucccugugcucgaucuccggcugggccaucuacaccaaggacaacagcauccggaucggguccaagggcgacguguucgugauccgcgagccguucaucagcugcucccaccucgagugccggaccuucuuccugacgcagggggcccugcucaacgacaagcacucgaacggcaccgucaaggaccgcucccccuaccgggcccugaugagcugcccccugggggaggcgcccagcccguacaacuccaaguucgagucgguggccugguccgccagcgccugccacgacggcaugggcuggcucaccaucgggaucuccggccccgacaacggggcgguggccguccugaaguacaacggcaucaucaccggcacgaucaagagcuggaagaagcagauccugcgcacccaggaguccgagugcgugugcaugaacgggucgugcuucaccaucaugaccgacggccccuccaacaaggccgccagcuacaagaucuucaagaucgagaaggggaaggugacgaaguccaucgagcucaacgcccccaacuucuacuacgaggagugcagcugcuacccggacaccggcaucgucaugugcgugugccgggacaacuggcacggguccaaccgccccugggugucguucaaccagaaccuggaguaccagaucggcuacaucugcuccggcgucuucggggacaacccccggcccgaggacggcgaggggagcugcaacccggugaccguggacggcgcgaacggggucaagggcuucuccuacaaguacggcaacgggguguggaucggccgcaccaagagcaaccggcugcgcaagggguucgagaugaucugggaccccaacggcuggacgaacaccgacuccgacuucucggugaagcaggacgucguggccaucaccgacuggagcggguacuccggcagcuucgugcagcaccccgagcucaccggccuggacugcauccggcccugcuucugggucgagcuggugcgcgggcucccgcgggagaacacgaccaucuggaccuccggcucguccaucagcuucugcggggucaacuccgacaccgccaacuggagcuggcccgacggcgccgagcugcccuucacgaucgacaaguga

SEQ ID NO: 22632 - RNA, 1413 nt, Artificial Sequence; identical to SEQ ID NO: 22607
  derived and/or modified CDS sequence (AUadapt) from InfluenzaA__ADW10596__NA

SEQ ID NO: 22633 - RNA, 1413 nt, Artificial Sequence; identical to SEQ ID NO: 22606
  derived and/or modified CDS sequence (AUadapt) from InfluenzaA__ADW10607__NA

SEQ ID NO: 22634 - RNA, 1413 nt, Artificial Sequence; identical to SEQ ID NO: 22606
  derived and/or modified CDS sequence (AUadapt) from InfluenzaA__ADW10618__NA

SEQ ID NO: 22635 - RNA, 1413 nt, Artificial Sequence; identical to SEQ ID NO: 22606
  derived and/or modified CDS sequence (AUadapt) from InfluenzaA__ADW10629__NA

SEQ ID NO: 22636 - RNA, 1413 nt, Artificial Sequence; identical to SEQ ID NO: 22606
  derived and/or modified CDS sequence (AUadapt) from InfluenzaA__ADW10724__NA

SEQ ID NO: 22637 - RNA, 1413 nt, Artificial Sequence; identical to SEQ ID NO: 22607
  derived and/or modified CDS sequence (AUadapt) from InfluenzaA__ADW10735__NA

SEQ ID NO: 22638 - RNA, 1413 nt, Artificial Sequence; identical to SEQ ID NO: 22607
  derived and/or modified CDS sequence (AUadapt) from InfluenzaA__ADW10746__NA

SEQ ID NO: 22639 - RNA, 1413 nt, Artificial Sequence
  derived and/or modified CDS sequence (AUadapt) from InfluenzaA__ADW10757__NA
augaaccccaaccagaagaucaucaccaucggcucgaucuccaucgccaucgggaucaucagccugaugcuccagaucggcaacaucaucuccaucugggccucgcacuccauccagacccgcagccagaacaacacggggaucugcaaccagcggaucaucaccuacgagaacuccaccugggugaaccacaccuacgucaacaucaacaacacgaacgugguggcgggcggggacaagaccagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcacguucuuccugacccagggggcccugcucaacgacaagcacuccaacggcaccgucaaggaccggagccccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagucggagugcgugugcaugaacggguccugcuucacccucaugacggacggccccagcaacaaggccgccuccuacaagaucuucaagaucgagaaggggaaggugaccaagagcaucgagcugaacgcccccaacuucuacuacgaggagugcuccugcuacccggacaccggcaucgucaugugcgugugccgcgacaacuggcacgggucgaaccggcccuggguguccuucaaccagaaccuggacuaccagaucggcuacaucugcagcggcgucuucggggacaacccccgccccgaggacggcgagggguccugcaacccggugaccguggacggcgcgaacggggucaagggcuucagcuacaaguacggcaacgggguguggaucggccggacgaaguccaaccgccuccggaagggguucgagaugaucugggaccccaacggcuggaccaacaccgacucggacuucuccgugaagcaggacgucguggccaucaccgacuggagcggguacagcggcuccuucgugcagcaccccgagcugacgggccuggacugcauccgccccugcuucugggucgagcucgugcgggggcugccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 22640 - RNA, 1413 nt, Artificial Sequence; identical to SEQ ID NO: 22606
  derived and/or modified CDS sequence (AUadapt) from InfluenzaA__ADW10768__NA

SEQ ID NO: 22641 - RNA, 1413 nt, Artificial Sequence; identical to SEQ ID NO: 19863
  derived and/or modified CDS sequence (AUadapt) from InfluenzaA__ADW10779__NA

SEQ ID NO: 22642 - RNA, 1413 nt, Artificial Sequence
  derived and/or modified CDS sequence (AUadapt) from InfluenzaA__ADW10790__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcacgaaguccaaccggcugcgcaagggguucgagaugaucugggaccccaacggcuggaccaacaccgacagcgacuucuccgugaagcaggacgucguggccaucaccgacuggagcggguacucgggcuccuucgugcagcaccccgagcucacgggccuggacugcaucauccccugcuucugggucgagcuggugcgggggcucccgcgcgagaacgccaccaucuggaccagcggcuccagcaucuccuucugcggggucaacagcgacaccgccaacugguccuggcccgacggcgccgagcugcccuucacgaucgacaaguga

SEQ ID NO: 22643 - RNA, 1413 nt, Artificial Sequence; identical to SEQ ID NO: 21332
  derived and/or modified CDS sequence (AUadapt) from InfluenzaA__ADW10801__NA

SEQ ID NO: 22644 - RNA, 1413 nt, Artificial Sequence; identical to SEQ ID NO: 22606
  derived and/or modified CDS sequence (AUadapt) from InfluenzaA__ADW10812__NA

SEQ ID NO: 22645 - RNA, 1413 nt, Artificial Sequence; identical to SEQ ID NO: 22358
  derived and/or modified CDS sequence (AUadapt) from InfluenzaA__ADW10823__NA

SEQ ID NO: 22646 - RNA, 1413 nt, Artificial Sequence
  derived and/or modified CDS sequence (AUadapt) from InfluenzaA__ADW10834__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaucaagucgaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcaccaaguccaaccggcugcgcaagggguucgagaugaucugggaccccaacggcuggacgaacaccgacagcgacuucuccgugaagcaggacgucguggccaucaccgacuggagcggguacucgggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 22647 - RNA, 1413 nt, Artificial Sequence; identical to SEQ ID NO: 22607
  derived and/or modified CDS sequence (AUadapt) from InfluenzaA__ADW10845__NA

SEQ ID NO: 22648 - RNA, 1413 nt, Artificial Sequence
  derived and/or modified CDS sequence (AUadapt) from InfluenzaA__ADW10856__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaaccagcggaucaucaccuacgagaacuccaccugggugaaccacaccuacgucaacaucaacaacacgaacgugguggcgggggaggacaagaccagcaugacccuggccggcaacuccucgcugugcuccaucagcggcugggccaucuacaccaaggacaacuccauccgcaucgggucgaagggcgacgucuucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccucgccguacaacagcaaguucgaguccguggccuggagcgccuccgcgugccacgacggcaugggcuggcucaccaucgggaucucgggccccgacaacggggccgucgccgugcugaaguacaacggcaucaucacgggcaccaucaaguccuggaagaagcagauccugcggacccaggagagcgagugcgugugcaugaacggguccugcuucaccaucaugacggacggccccucgaacaaggccgccuccuacaagaucuucaagaucgagaaggggaaggucaccaagagcaucgagcucaacgcgcccaacuucuacuacgaggagugcuccugcuacccggacaccggcaucgugaugugcgugugccgcgacaacuggcacgggagcaaccggcccugggucuccuucaaccagaaccuggacuaccagaucggcuacaucugcucgggcguguucggggacaacccccgccccgaggacggcgagggguccugcaacccggugaccgucgacggcgccaacggggugaagggcuucagcuacaaguacggcaacgggguguggaucggccggacgaaguccaaccgccugcggaagggguucgagaugaucugggaccccaacggcuggaccaacaccgacucggacuucuccgucaagcaggacgugguggccaucaccgacuggagcggguacagcggcuccuucguccagcaccccgagcucacgggccuggacugcauccgccccugcuucuggguggagcuggugcgggggcucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 22649 - RNA, 1413 nt, Artificial Sequence; identical to SEQ ID NO: 22606
  derived and/or modified CDS sequence (AUadapt) from InfluenzaA__ADW10867__NA

SEQ ID NO: 22650 - RNA, 1413 nt, Artificial Sequence; identical to SEQ ID NO: 22606
  derived and/or modified CDS sequence (AUadapt) from InfluenzaA__ADW10878__NA

SEQ ID NO: 22651 - RNA, 1413 nt, Artificial Sequence; identical to SEQ ID NO: 22606
  derived and/or modified CDS sequence (AUadapt) from InfluenzaA__ADW10889__NA

SEQ ID NO: 22652 - RNA, 1413 nt, Artificial Sequence; identical to SEQ ID NO: 19863
  derived and/or modified CDS sequence (AUadapt) from InfluenzaA__ADW10900__NA

SEQ ID NO: 22653 - RNA, 1410 nt, Artificial Sequence; identical to SEQ ID NO: 20886
  derived and/or modified CDS sequence (AUadapt) from InfluenzaA__ADW11155__NA

SEQ ID NO: 22654 - RNA, 1410 nt, Artificial Sequence; identical to SEQ ID NO: 16318
  derived and/or modified CDS sequence (AUadapt) from InfluenzaA__ADW23530__NA

SEQ ID NO: 22655 - RNA, 1410 nt, Artificial Sequence
  derived and/or modified CDS sequence (AUadapt) from InfluenzaA__ADW54483__NA
augaaccccaaccagaagaucaucaccaucggcucggugugcaugaccaucgggauggccaaccugaugcuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 22656 - RNA, 1410 nt, Artificial Sequence
  derived and/or modified CDS sequence (AUadapt) from InfluenzaA__ADW54494__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucaucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 22657 - RNA, 1410 nt, Artificial Sequence
  derived and/or modified CDS sequence (AUadapt) from InfluenzaA__ADW54514__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggaagaacaacauccugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccgcaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaagaagcaggacaucaucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22658 - RNA, 1410 nt, Artificial Sequence
  derived and/or modified CDS sequence (AUadapt) from InfluenzaA__ADW54522__NA
augaaccccaaccagaagaucaucaccaucggcucggugugcaugaucaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugucgugcccgaucggcgagguccccucccccuacaacagccgguucgagagcguggccugguccgcgagcgccugccacgacgggaucaacuggcucacgaucggcaucuccggccccgacaacggggccguggccguccugaaguacaacggcaucaucaccgacaccaucaagagcuggcgcaacaaccggcugcgcacccaggaguccgagugcgcgugcgugaacgggucgugcuucacggugaugaccgacggcccguccgacggccaggccagcuacaagaucuuccggaucgagaaggggaagaucgucaaguccguggagaugaacgcccccaacuaccacuacgaggagugcagcugcuaccccgacuccagcgagaucacgugcgugugccgcgacaacuggcacggcuccaaccggcccugggucucguucaaccagaaccucgaguaccagaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaagggcuucgagaugaucugggaccccaacggguggaccggcaccgacaacaacuucucgaucaagcaggacaucguggggaucaacgagugguccggcuacagcggguccuucgugcagcacccggagcugaccggccuggacugcauccggcccugcuucugggucgagcucauccgcggccggcccaaggagaacacgaucuggaccagcggguccagcaucuccuucugcggcgugaacagcgacaccgucgggugguccuggcccgacggcgccgagcugccguucaccaucgacaaguga

SEQ ID NO: 22659 - RNA, 1410 nt, Artificial Sequence
  derived and/or modified CDS sequence (AUadapt) from InfluenzaA__ADW65826__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 22660 - RNA, 1410 nt, Artificial Sequence; identical to SEQ ID NO: 19001
  derived and/or modified CDS sequence (AUadapt) from InfluenzaA__ADW80519__NA

SEQ ID NO: 22661 - RNA, 1410 nt, Artificial Sequence; identical to SEQ ID NO: 19001
  derived and/or modified CDS sequence (AUadapt) from InfluenzaA__ADW82127__NA

SEQ ID NO: 22662 - RNA, 1410 nt, Artificial Sequence; identical to SEQ ID NO: 19001
  derived and/or modified CDS sequence (AUadapt) from InfluenzaA__ADW82138__NA

SEQ ID NO: 22663 - RNA, 1410 nt, Artificial Sequence; identical to SEQ ID NO: 19001
  derived and/or modified CDS sequence (AUadapt) from InfluenzaA__ADW82149__NA

SEQ ID NO: 22664 - RNA, 1410 nt, Artificial Sequence; identical to SEQ ID NO: 19001
  derived and/or modified CDS sequence (AUadapt) from InfluenzaA__ADW82158__NA

SEQ ID NO: 22665 - RNA, 1410 nt, Artificial Sequence; identical to SEQ ID NO: 19001
  derived and/or modified CDS sequence (AUadapt) from InfluenzaA__ADW82169__NA

SEQ ID NO: 22666 - RNA, 1410 nt, Artificial Sequence; identical to SEQ ID NO: 19001
  derived and/or modified CDS sequence (AUadapt) from InfluenzaA__ADW82180__NA

SEQ ID NO: 22667 - RNA, 1410 nt, Artificial Sequence; identical to SEQ ID NO: 16318
  derived and/or modified CDS sequence (AUadapt) from InfluenzaA__ADW82191__NA

SEQ ID NO: 22668 - RNA, 1410 nt, Artificial Sequence; identical to SEQ ID NO: 16318
  derived and/or modified CDS sequence (AUadapt) from InfluenzaA__ADW82201__NA

SEQ ID NO: 22669 - RNA, 1410 nt, Artificial Sequence; identical to SEQ ID NO: 16318
  derived and/or modified CDS sequence (AUadapt) from InfluenzaA__ADW82211__NA

SEQ ID NO: 22670 - RNA, 1410 nt, Artificial Sequence; identical to SEQ ID NO: 16318
  derived and/or modified CDS sequence (AUadapt) from InfluenzaA__ADW82221__NA

SEQ ID NO: 22671 - RNA, 1410 nt, Artificial Sequence; identical to SEQ ID NO: 16318
  derived and/or modified CDS sequence (AUadapt) from InfluenzaA__ADW82231__NA

SEQ ID NO: 22672 - RNA, 1410 nt, Artificial Sequence; identical to SEQ ID NO: 16318
  derived and/or modified CDS sequence (AUadapt) from InfluenzaA__ADW82241__NA

SEQ ID NO: 22673 - RNA, 1410 nt, Artificial Sequence; identical to SEQ ID NO: 16318
  derived and/or modified CDS sequence (AUadapt) from InfluenzaA__ADW82251__NA

SEQ ID NO: 22674 - RNA, 1410 nt, Artificial Sequence; identical to SEQ ID NO: 16318
  derived and/or modified CDS sequence (AUadapt) from InfluenzaA__ADW82261__NA

SEQ ID NO: 22675 - RNA, 1410 nt, Artificial Sequence; identical to SEQ ID NO: 16318
  derived and/or modified CDS sequence (AUadapt) from InfluenzaA__ADW82271__NA

SEQ ID NO: 22676 - RNA, 1410 nt, Artificial Sequence; identical to SEQ ID NO: 22659
  derived and/or modified CDS sequence (AUadapt) from InfluenzaA__ADW95306__NA

SEQ ID NO: 22677 - RNA, 1410 nt, Artificial Sequence; identical to SEQ ID NO: 22659
  derived and/or modified CDS sequence (AUadapt) from InfluenzaA__ADW95313__NA

SEQ ID NO: 22678 - RNA, 1410 nt, Artificial Sequence; identical to SEQ ID NO: 22659
  derived and/or modified CDS sequence (AUadapt) from InfluenzaA__ADW95320__NA

SEQ ID NO: 22679 - RNA, 1410 nt, Artificial Sequence; identical to SEQ ID NO: 22659
  derived and/or modified CDS sequence (AUadapt) from InfluenzaA__ADW95327__NA

SEQ ID NO: 22680 - RNA, 1410 nt, Artificial Sequence
  derived and/or modified CDS sequence (AUadapt) from InfluenzaA__ADW95333__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucucguucaaguacggcaacgggguguggaucggcagcgccaaguccaucagcucccgcaaggcguucgagaugaucugggaccccaacggcuggaccgggaccgacaacaacuucagcaucaagcaguacaucgucggcaucaacgagugguccggguacagcggcuccuucguggagcacccggagcugaccgggcuggacugcauccggcccugcuucuggguggagcucauccgcggccggcccaaggagaacacgaucuggaccagcggcuccagcaucuccuucugcggggucaacagcgacaccgugggcugguccuggcccgacggggccgagcugccguucaccaucgacaaguga

SEQ ID NO: 22681 - RNA, 1410 nt, Artificial Sequence
  derived and/or modified CDS sequence (AUadapt) from InfluenzaA__ADX20813__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagcucguggccuggucggcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgagcgacggccagaccuccuacaagaucuuccgcaucgagaaggggaagaucgucaagagcguggagaugaacgcccccaacuacuacuacgaggagugcuccugcuaccccgacucguccgagaucacgugcgugugccgggacaacuggcacggcagcaaccgccccugggucuccuucaaccagaaccuggaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcucgcggaagggcuucgagaugaucugggaccccaacggguggaccggcacggacaacaacuucuccaucaagcaggacaucguggggaucaacgaguggagcggcuacuccgggagcuucgugcagcacccggagcugaccggccucgacugcauccgccccugcuucugggucgagcugauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 22682 - RNA, 1410 nt, Artificial Sequence
  derived and/or modified CDS sequence (AUadapt) from InfluenzaA__ADX20814__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuacuacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 22683 - RNA, 1410 nt, Artificial Sequence; identical to SEQ ID NO: 19001
  derived and/or modified CDS sequence (AUadapt) from InfluenzaA__ADX21091__NA

SEQ ID NO: 22684 - RNA, 1410 nt, Artificial Sequence; identical to SEQ ID NO: 16318
  derived and/or modified CDS sequence (AUadapt) from InfluenzaA__ADX21101__NA

SEQ ID NO: 22685 - RNA, 1410 nt, Artificial Sequence; identical to SEQ ID NO: 20007
  derived and/or modified CDS sequence (AUadapt) from InfluenzaA__ADX36112__NA

SEQ ID NO: 22686 - RNA, 1410 nt, Artificial Sequence
  derived and/or modified CDS sequence (AUadapt) from InfluenzaA__ADX87386__NA
augaaccccaaccagcgcaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcggaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccguguga

SEQ ID NO: 22687 - RNA, 1410 nt, Artificial Sequence
  derived and/or modified CDS sequence (AUadapt) from InfluenzaA__ADX96270__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcaucaucaccuacgagaacaacaccugggucaaccagaccuacgugaacaucuccaacacgaacuucgccgcgggccagagcguggccuccgucaagcuggccgggaacucgucccucugcccggugagcggcugggccaucuacuccaaggacaacagcgugcgcaucggcuccaagggggacgucuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgcggagcugccguucacgaucgacaaguga

SEQ ID NO: 22688 - RNA, 1410 nt, Artificial Sequence; identical to SEQ ID NO: 22687
  derived and/or modified CDS sequence (AUadapt) from InfluenzaA__ADX96280__NA

SEQ ID NO: 22689 - RNA, 1410 nt, Artificial Sequence; identical to SEQ ID NO: 19723
  derived and/or modified CDS sequence (AUadapt) from InfluenzaA__ADX96290__NA

SEQ ID NO: 22690 - RNA, 1410 nt, Artificial Sequence; identical to SEQ ID NO: 16318
  derived and/or modified CDS sequence (AUadapt) from InfluenzaA__ADX96300__NA

SEQ ID NO: 22691 - RNA, 1410 nt, Artificial Sequence; identical to SEQ ID NO: 16318
  derived and/or modified CDS sequence (AUadapt) from InfluenzaA__ADX96310__NA

SEQ ID NO: 22692 - RNA, 1410 nt, Artificial Sequence
  derived and/or modified CDS sequence (AUadapt) from InfluenzaA__ADX96330__NA
augaaccccaaccagaagaucaucaccaucggcucggugugcaugaccaucgggauggccaaccugauccuccagaucggcaacgggaucuccaucuggaucagccacuccauccagcugggcaaccagaaccagaucgagacgugcaaccagagcgucaucaccuacgagaacaacaccugggugaaccagaccuacgugaacaucuccaacacgaacuucgccgcggggcagucggucguguccgugaagcuggccggcaacagcucccucugcccggucagcggcugggccaucuacuccaaggacaacagcauccgcaucggguccaagggcgacguguucgugauccgggagcccuucaucucgugcagcccccuggagugccgcaccuucuuccugacccagggggcccuccugaacgacaagcacuccaacggcaccaucaaggaccggucccccuaccgcacgcugaugagcugcccgaucggggagguccccucccccuacaacucgcgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcucgugcuucaccgugaugaccgacggcccguccgacgggcaggccagcuacaagaucuuccgcaucgagaagggcaagaucgucaaguccguggagaugaacgcccccaacuaccacuacgaggagugcagcugcuaccccgacuccaacgagaucacgugcgugugccgggacaacuggcacgggucgaaccgccccugggucuccuucaaccagaaccucgaguaccagaucggcuacaucugcagcgggaucuucggcgacaacccgcggcccaacgacaagaccggcuccugcgggcccgugagcuccaacggcgccaacggggugaagggcuucagcuucaaguacgggaacggcgucuggaucggccgcaccaaguccaucucgagccggaacggguucgagaugaucugggaccccaacggcuggaccgggaccgacaacaacuucuccaucaagcaggacaucgugggcaucaacgaguggagcggguacuccggcucguucgugcagcacccggagcugacgggccuggacugcauccgccccugcuucugggucgagcucauccgggggcgccccaaggagaacaccaucuggaccuccggcagcuccaucagcuucugcggggugaacuccgacaccgucggcuggagcuggcccgacggcgccgagcugccguucacgaucgacaaguga

SEQ ID NO: 22693 - RNA, 1410 nt, Artificial Sequence; identical to SEQ ID NO: 16318
  derived and/or modified CDS sequence (AUadapt) from InfluenzaA__ADX96339__NA

SEQ ID NO: 22694 - RNA, 1410 nt, Artificial Sequence
  derived and/or modified CDS sequence (AUadapt) from InfluenzaA__ADX96349__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccaacgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22695 - RNA, 1410 nt, Artificial Sequence; identical to SEQ ID NO: 16318
  derived and/or modified CDS sequence (AUadapt) from InfluenzaA__ADX96359__NA

SEQ ID NO: 22696 - RNA, 1410 nt, Artificial Sequence; identical to SEQ ID NO: 16318
  derived and/or modified CDS sequence (AUadapt) from InfluenzaA__ADX96369__NA

SEQ ID NO: 22697 - RNA, 1410 nt, Artificial Sequence
  derived and/or modified CDS sequence (AUadapt) from InfluenzaA__ADX96380__NA
augaaccccaaccagaagaucaucaccaucggcucggugugcaugaccaucgggauggccaaccugauccuccagaucggcaacaucaucuccaucuggccgguccacagcauccagcuggggaaccagaaccagaucgagacgugcaaccaguccgugaucaccuacgagaacaacaccugggugaaccagaccuacgucaacaucagcaacacgaacuucgccgcgggccaguccguggugucgaugaagcuggccgggaacuccagccucugccccgucggcggcugggccaucuacuccaaggacaacagcgugcgcaucggguccaagggcgacguguucgucauccgggagcccuucaucagcugcucgccccuggagugccgcaccuucuuccugacccagggggcccuccugaacgacaagcacuccaacggcaccaucaaggaccgguccccguaccgcacgcugaugagcugccccaucggggaggugcccucccccuacaacagccgguucgaguccguggccuggagcgcgucggccugccacgacggcaucaacuggcucaccaucggcaucuccgggccggacaacggcgccgucgccgugcugaaguacaacgggaucaucaccgacaccaucaagagcuggcgcaacaacauccugcggacgcaggaguccgagugcgcgugcgugaacggcagcugcuucaccgucaugaccgacggccccuccgacgggcaggccagcuacaagaucuuccgcaucgagaagggcaagaucguggaguccguggagaugaacgcccccaacuaccacuacgaggagugcucgugcuaccccgacuccagcgagaucacgugcgucugccgggacaacuggcacggguccaaccgcccgugggugagcuucaaccagaaccucgaguaccagaucggcuacaucugcuccgggaucuucggcgacaacccccggcccaacgacaagaccggcagcugcgggcccguguccucgaacggcgccaacggggucaagggcuucuccuucaaguacgggaacggcguguggaucggccgcaccaagagcaucuccagccggaacggguucgagaugaucugggacccgaacggcuggaccgggaccgacaacaacuucagcaucaagcaggacaucgugggcaucaacgagugguccggguacucgggcuccuucguccagcaccccgagcugacgggccuggacugcauccgccccugcuucuggguggagcucauccgggggcgccccaaggagaacaccaucuggaccagcggcuccagcaucuccuucugcggggucaacagcgacaccgugggcugguccuggccggacggcgccgagcugcccuucacgaucgacaaguga

SEQ ID NO: 22698 - RNA, 1410 nt, Artificial Sequence
  derived and/or modified CDS sequence (AUadapt) from InfluenzaA__ADX96390__NA
augaaccccaaccagaagaucaucaccaucggcucggugugcaugaccaucgggauggccaaccugauccuccagaucggcaacaucaucuccaucuggcugagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgagguccccucccccuacaacagccgguucgagagcguggccugguccgcgagcgccugccacgacgggaucaacuggcugaccaucggcaucuccggccccgacaacggggccguggccguccugaaguacaacggcaucaucaccgacaccaucaagagcuggcgcaacaacauccuccggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22699 - RNA, 1410 nt, Artificial Sequence; identical to SEQ ID NO: 16318
  derived and/or modified CDS sequence (AUadapt) from InfluenzaA__ADX96400__NA

SEQ ID NO: 22700 - RNA, 1410 nt, Artificial Sequence; identical to SEQ ID NO: 16318
  derived and/or modified CDS sequence (AUadapt) from InfluenzaA__ADX96410__NA

SEQ ID NO: 22701 - RNA, 1410 nt, Artificial Sequence; identical to SEQ ID NO: 16318
  derived and/or modified CDS sequence (AUadapt) from InfluenzaA__ADX96419__NA

SEQ ID NO: 22702 - RNA, 1410 nt, Artificial Sequence
  derived and/or modified CDS sequence (AUadapt) from InfluenzaA__ADX96429__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccaacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgugcgcaucaacgagugguccggguacagcggcuccuucguccagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 22703 - RNA, 1410 nt, Artificial Sequence; identical to SEQ ID NO: 16318
  derived and/or modified CDS sequence (AUadapt) from InfluenzaA__ADX96449__NA

SEQ ID NO: 22704 - RNA, 1410 nt, Artificial Sequence; identical to SEQ ID NO: 16318
  derived and/or modified CDS sequence (AUadapt) from InfluenzaA__ADX96469__NA

SEQ ID NO: 22705 - RNA, 1410 nt, Artificial Sequence; identical to SEQ ID NO: 16318
  derived and/or modified CDS sequence (AUadapt) from InfluenzaA__ADX96489__NA

SEQ ID NO: 22706 - RNA, 1410 nt, Artificial Sequence; identical to SEQ ID NO: 16318
  derived and/or modified CDS sequence (AUadapt) from InfluenzaA__ADX96499__NA

SEQ ID NO: 22707 - RNA, 1410 nt, Artificial Sequence
  derived and/or modified CDS sequence (AUadapt) from InfluenzaA__ADX96509__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaacggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22708 - RNA, 1410 nt, Artificial Sequence; identical to SEQ ID NO: 16318
  derived and/or modified CDS sequence (AUadapt) from InfluenzaA__ADX96519__NA

SEQ ID NO: 22709 - RNA, 1410 nt, Artificial Sequence; identical to SEQ ID NO: 16318
  derived and/or modified CDS sequence (AUadapt) from InfluenzaA__ADX96529__NA

SEQ ID NO: 22710 - RNA, 1410 nt, Artificial Sequence; identical to SEQ ID NO: 16318
  derived and/or modified CDS sequence (AUadapt) from InfluenzaA__ADX96539__NA

SEQ ID NO: 22711 - RNA, 1410 nt, Artificial Sequence; identical to SEQ ID NO: 16318
  derived and/or modified CDS sequence (AUadapt) from InfluenzaA__ADX96549__NA

SEQ ID NO: 22712 - RNA, 1410 nt, Artificial Sequence; identical to SEQ ID NO: 16318
  derived and/or modified CDS sequence (AUadapt) from InfluenzaA__ADX96559__NA

SEQ ID NO: 22713 - RNA, 1410 nt, Artificial Sequence; identical to SEQ ID NO: 16318
  derived and/or modified CDS sequence (AUadapt) from InfluenzaA__ADX96569__NA

SEQ ID NO: 22714 - RNA, 1410 nt, Artificial Sequence; identical to SEQ ID NO: 16274
  derived and/or modified CDS sequence (AUadapt) from InfluenzaA__ADX96579__NA

SEQ ID NO: 22715 - RNA, 1410 nt, Artificial Sequence; identical to SEQ ID NO: 16318
  derived and/or modified CDS sequence (AUadapt) from InfluenzaA__ADX96589__NA

SEQ ID NO: 22716 - RNA, 1410 nt, Artificial Sequence; identical to SEQ ID NO: 16318
  derived and/or modified CDS sequence (AUadapt) from InfluenzaA__ADX96599__NA

SEQ ID NO: 22717 - RNA, 1410 nt, Artificial Sequence
  derived and/or modified CDS sequence (AUadapt) from InfluenzaA__ADX96609__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucggcggcugggccaucuacagcaaggacaacuccgugcgcaucgggagcaagggcgacguguucgucauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggaggugcccagccccuacaacucccgguucgagagcguggccuggagcgcguccgccugccacgacggcaucaacuggcucaccaucggcaucucggggcccgacaacggcgccgucgccgugcugaaguacaacgggaucaucaccgacaccaucaaguccuggcgcaacaacauccugcggacgcaggagagcgagugcgcgugcgugaacggcuccugcuucaccgucaugaccgacggcccgagcaacgggcaggccuccuacaagaucuuccgcaucgagaagggcaagaucgucaagagcguggagaugaacgcccccaacuaccacuacgaggagugcuccugcuaccccgacucguccgagaucacgugcgugugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacggggacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 22718 - RNA, 1410 nt, Artificial Sequence; identical to SEQ ID NO: 16274
  derived and/or modified CDS sequence (AUadapt) from InfluenzaA__ADX96619__NA

SEQ ID NO: 22719 - RNA, 1410 nt, Artificial Sequence; identical to SEQ ID NO: 16318
  derived and/or modified CDS sequence (AUadapt) from InfluenzaA__ADX96629__NA

SEQ ID NO: 22720 - RNA, 1410 nt, Artificial Sequence; identical to SEQ ID NO: 16318
  derived and/or modified CDS sequence (AUadapt) from InfluenzaA__ADX96639__NA

SEQ ID NO: 22721 - RNA, 1410 nt, Artificial Sequence; identical to SEQ ID NO: 16318
  derived and/or modified CDS sequence (AUadapt) from InfluenzaA__ADX96649__NA

SEQ ID NO: 22722 - RNA, 1410 nt, Artificial Sequence; identical to SEQ ID NO: 16274
  derived and/or modified CDS sequence (AUadapt) from InfluenzaA__ADX96659__NA

SEQ ID NO: 22723 - RNA, 1410 nt, Artificial Sequence; identical to SEQ ID NO: 16318
  derived and/or modified CDS sequence (AUadapt) from InfluenzaA__ADX96669__NA

SEQ ID NO: 22724 - RNA, 1410 nt, Artificial Sequence; identical to SEQ ID NO: 16318
  derived and/or modified CDS sequence (AUadapt) from InfluenzaA__ADX96679__NA

SEQ ID NO: 22725 - RNA, 1410 nt, Artificial Sequence; identical to SEQ ID NO: 16318
  derived and/or modified CDS sequence (AUadapt) from InfluenzaA__ADX96689__NA

SEQ ID NO: 22726 - RNA, 1410 nt, Artificial Sequence; identical to SEQ ID NO: 16318
  derived and/or modified CDS sequence (AUadapt) from InfluenzaA__ADX96699__NA

SEQ ID NO: 22727 - RNA, 1410 nt, Artificial Sequence
  derived and/or modified CDS sequence (AUadapt) from InfluenzaA__ADX96709__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacgagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22728 - RNA, 1410 nt, Artificial Sequence
  derived and/or modified CDS sequence (AUadapt) from InfluenzaA__ADX96719__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaguucgccgggaacagcucccugugcccggucucgggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcucacgggccuggacugcauccgccccugcuucugggucgagcugauccggggccgccccaaggagagcaccguguggaccuccgggagcuccaucagcuucugcggcgucaacuccgacaccgugggguggagcuggcccgacggcgccgagcucccguucacgaucgacaaguga

SEQ ID NO: 22729 - RNA, 1410 nt, Artificial Sequence; identical to SEQ ID NO: 16318
  derived and/or modified CDS sequence (AUadapt) from InfluenzaA__ADX96729__NA

SEQ ID NO: 22730 - RNA, 1410 nt, Artificial Sequence
  derived and/or modified CDS sequence (AUadapt) from InfluenzaA__ADX96739__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacucgaacgggaccaucaaggaccggucccccuaccgcacgcugaugagcugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagucguggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaaguccgacaccgucgggugguccuggcccgacggcgccgagcugccguucacgaucgacaaguga

SEQ ID NO: 22731 - RNA, 1410 nt, Artificial Sequence; identical to SEQ ID NO: 16318
  derived and/or modified CDS sequence (AUadapt) from InfluenzaA__ADX96749__NA

SEQ ID NO: 22732 - RNA, 1410 nt, Artificial Sequence; identical to SEQ ID NO: 16318
  derived and/or modified CDS sequence (AUadapt) from InfluenzaA__ADX96759__NA

SEQ ID NO: 22733 - RNA, 1410 nt, Artificial Sequence; identical to SEQ ID NO: 20114
  derived and/or modified CDS sequence (AUadapt) from InfluenzaA__ADX96769__NA

SEQ ID NO: 22734 - RNA, 1410 nt, Artificial Sequence; identical to SEQ ID NO: 16318
  derived and/or modified CDS sequence (AUadapt) from InfluenzaA__ADX96779__NA

SEQ ID NO: 22735 - RNA, 1410 nt, Artificial Sequence
  derived and/or modified CDS sequence (AUadapt) from InfluenzaA__ADX96789__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucgugucccugaagcucgccgggaacucgucccugugcccggugagcggcugggccaucuacuccaaggacaacagcauccgcaucggcuccaagggggacgucuucgugauccgggagcccuucaucagcugcagcccccuggagugccgcaccuucuuccucacccagggcgcccugcugaacgacaagcacuccaacgggaccaucaaggaccggucccccuaccgcacgcucaugucgugcccgaucggcgaggugcccucccccuacaacagccgguucgagagcgucgccugguccgcgagcgccugccacgacgggaucaacuggcugaccaucggcaucuccggccccgacaacggggccguggccgugcugaaguacaacggcaucaucaccgacaccaucaagagcuggcgcaacaacauccuccggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccucgacugcauccgccccugcuucuggguggagcugauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22736 - RNA, 1410 nt, Artificial Sequence; identical to SEQ ID NO: 16318
  derived and/or modified CDS sequence (AUadapt) from InfluenzaA__ADX96799__NA

SEQ ID NO: 22737 - RNA, 1410 nt, Artificial Sequence; identical to SEQ ID NO: 19295
  derived and/or modified CDS sequence (AUadapt) from InfluenzaA__ADX96809__NA

SEQ ID NO: 22738 - RNA, 1410 nt, Artificial Sequence; identical to SEQ ID NO: 16318
  derived and/or modified CDS sequence (AUadapt) from InfluenzaA__ADX96819__NA

SEQ ID NO: 22739 - RNA, 1410 nt, Artificial Sequence; identical to SEQ ID NO: 20363
  derived and/or modified CDS sequence (AUadapt) from InfluenzaA__ADX96829__NA

SEQ ID NO: 22740 - RNA, 1410 nt, Artificial Sequence
  derived and/or modified CDS sequence (AUadapt) from InfluenzaA__ADX96839__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacaacgugcgcaucggcagcaagggggacguguucgucauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgaggugcccagccccuacaacucccgguucgagagcguggccuggagcgcguccgccugccacgacgggaucaacuggcucaccaucggcaucucgggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgugagcuccaacggggccaacggcgucaagggguucucguucaaguacggcaacgggguguggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 22741 - RNA, 1410 nt, Artificial Sequence; identical to SEQ ID NO: 16318
  derived and/or modified CDS sequence (AUadapt) from InfluenzaA__ADX96849__NA

SEQ ID NO: 22742 - RNA, 1410 nt, Artificial Sequence; identical to SEQ ID NO: 16318
  derived and/or modified CDS sequence (AUadapt) from InfluenzaA__ADX96859__NA

SEQ ID NO: 22743 - RNA, 1410 nt, Artificial Sequence; identical to SEQ ID NO: 20363
  derived and/or modified CDS sequence (AUadapt) from InfluenzaA__ADX96869__NA

SEQ ID NO: 22744 - RNA, 1410 nt, Artificial Sequence; identical to SEQ ID NO: 16318
  derived and/or modified CDS sequence (AUadapt) from InfluenzaA__ADX96879__NA

SEQ ID NO: 22745 - RNA, 1410 nt, Artificial Sequence; identical to SEQ ID NO: 16318
  derived and/or modified CDS sequence (AUadapt) from InfluenzaA__ADX96899__NA

SEQ ID NO: 22746 - RNA, 1410 nt, Artificial Sequence
  derived and/or modified CDS sequence (AUadapt) from InfluenzaA__ADX96909__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacgacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaucaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucaacagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22747 - RNA, 1410 nt, Artificial Sequence; identical to SEQ ID NO: 16318
  derived and/or modified CDS sequence (AUadapt) from InfluenzaA__ADX96919__NA

SEQ ID NO: 22748 - RNA, 1410 nt, Artificial Sequence; identical to SEQ ID NO: 16318
  derived and/or modified CDS sequence (AUadapt) from InfluenzaA__ADX96929__NA

SEQ ID NO: 22749 - RNA, 1410 nt, Artificial Sequence; identical to SEQ ID NO: 16318
  derived and/or modified CDS sequence (AUadapt) from InfluenzaA__ADX96939__NA

SEQ ID NO: 22750 - RNA, 1410 nt, Artificial Sequence; identical to SEQ ID NO: 19723
  derived and/or modified CDS sequence (AUadapt) from InfluenzaA__ADX96949__NA

SEQ ID NO: 22751 - RNA, 1410 nt, Artificial Sequence; identical to SEQ ID NO: 16318
  derived and/or modified CDS sequence (AUadapt) from InfluenzaA__ADX96959__NA

SEQ ID NO: 22752 - RNA, 1410 nt, Artificial Sequence
  derived and/or modified CDS sequence (AUadapt) from InfluenzaA__ADX96969__NA
augaaccccaaccagaugaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22753 - RNA, 1410 nt, Artificial Sequence; identical to SEQ ID NO: 20363
  derived and/or modified CDS sequence (AUadapt) from InfluenzaA__ADX96979__NA

SEQ ID NO: 22754 - RNA, 1410 nt, Artificial Sequence; identical to SEQ ID NO: 20363
  derived and/or modified CDS sequence (AUadapt) from InfluenzaA__ADX96989__NA

SEQ ID NO: 22755 - RNA, 1407 nt, Artificial Sequence
  derived and/or modified CDS sequence (AUadapt) from InfluenzaA__ADX96999__NA
augaaccccaaccagaagaucaucaccaucggcucggugugcaugaccaucgggauggccaaccugauccuccagaucggcaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccaacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22756 - RNA, 1410 nt, Artificial Sequence; identical to SEQ ID NO: 16318
  derived and/or modified CDS sequence (AUadapt) from InfluenzaA__ADX97009__NA

SEQ ID NO: 22757 - RNA, 1410 nt, Artificial Sequence; identical to SEQ ID NO: 19295
  derived and/or modified CDS sequence (AUadapt) from InfluenzaA__ADX97020__NA

SEQ ID NO: 22758 - RNA, 1410 nt, Artificial Sequence
  derived and/or modified CDS sequence (AUadapt) from InfluenzaA__ADX97030__NA
augaaccccaaccagaagaucaucaccaucggcucggugugcaugaucaucgggauggccaaccugaugcuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcgugcgcaucggcuccaagggggacguguucgucauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgaggugcccucccccuacaacagccgguucgagucgguggccugguccgcgagcgccugccacgacgggaucaacuggcucacgaucggcaucuccggccccgacaacggggccgucgccgugcugaaguacaacggcaucaucaccgacaccaucaagagcuggcgcaacaacauccugcggacccaggaguccgagugcgcgugcgugaacgggagcugcuucacggucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugaccggccuggacugcauccgccccugcuucuggguggagcucauccggggccgccccaaggagaacacgaucuggaccagcggguccagcaucuccuucugcggcgucaacagcgacaccguggggugguccuggcccgacggcgccgagcugccguucaccaucgacaaguga

SEQ ID NO: 22759 - RNA, 1410 nt, Artificial Sequence; identical to SEQ ID NO: 20688
  derived and/or modified CDS sequence (AUadapt) from InfluenzaA__ADX98643__NA

SEQ ID NO: 22760 - RNA, 1410 nt, Artificial Sequence; identical to SEQ ID NO: 16318
  derived and/or modified CDS sequence (AUadapt) from InfluenzaA__ADX98653__NA

SEQ ID NO: 22761 - RNA, 1410 nt, Artificial Sequence
  derived and/or modified CDS sequence (AUadapt) from InfluenzaA__ADX98668__NA
augaaccccaaccagaagaucaucaccaucggcucgaucugcaucaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22762 - RNA, 1410 nt, Artificial Sequence; identical to SEQ ID NO: 16318
  derived and/or modified CDS sequence (AUadapt) from InfluenzaA__ADX98678__NA

SEQ ID NO: 22763 - RNA, 1410 nt, Artificial Sequence; identical to SEQ ID NO: 16318
  derived and/or modified CDS sequence (AUadapt) from InfluenzaA__ADX98698__NA

SEQ ID NO: 22764 - RNA, 1410 nt, Artificial Sequence
  derived and/or modified CDS sequence (AUadapt) from InfluenzaA__ADX98708__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaucuacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 22765 - RNA, 1410 nt, Artificial Sequence; identical to SEQ ID NO: 16318
  derived and/or modified CDS sequence (AUadapt) from InfluenzaA__ADX98722__NA

SEQ ID NO: 22766 - RNA, 1410 nt, Artificial Sequence; identical to SEQ ID NO: 16318
  derived and/or modified CDS sequence (AUadapt) from InfluenzaA__ADX98732__NA

SEQ ID NO: 22767 - RNA, 1410 nt, Artificial Sequence; identical to SEQ ID NO: 16318
  derived and/or modified CDS sequence (AUadapt) from InfluenzaA__ADX98742__NA

SEQ ID NO: 22768 - RNA, 1410 nt, Artificial Sequence; identical to SEQ ID NO: 20491
  derived and/or modified CDS sequence (AUadapt) from InfluenzaA__ADX98751__NA

SEQ ID NO: 22769 - RNA, 1410 nt, Artificial Sequence; identical to SEQ ID NO: 16318
  derived and/or modified CDS sequence (AUadapt) from InfluenzaA__ADX98761__NA

SEQ ID NO: 22770 - RNA, 1410 nt, Artificial Sequence
  derived and/or modified CDS sequence (AUadapt) from InfluenzaA__ADX98770__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggggagcuucaaccagaaccucgaguaccagaucggcuacaucugcuccgggaucuucggcgacaacccgcggcccaacgacaagaccggcagcugcgggcccgucuccucgaacggcgccaacggggugaagggcuucuccuucaaguacgggaacggcguguggaucggccgcaccaagagcaucagcucccggaacggguucgagaugaucugggaccccaacggcuggaccgggaccgacaacaacuucagcaucaagcaggacaucgucggcaucaacgagugguccggguacucgggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 22771 - RNA, 1410 nt, Artificial Sequence; identical to SEQ ID NO: 16318
  derived and/or modified CDS sequence (AUadapt) from InfluenzaA__ADX98780__NA

SEQ ID NO: 22772 - RNA, 1410 nt, Artificial Sequence
  derived and/or modified CDS sequence (AUadapt) from InfluenzaA__ADX98788__NA
augaaccccaaccagaagaucaucaccaucggcucggugugcaugaccaucgggauggccaaccugguccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaaguucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22773 - RNA, 1410 nt, Artificial Sequence
  derived and/or modified CDS sequence (AUadapt) from InfluenzaA__ADX98809__NA
augaaccccaaccagaagaucaucaccaucggcucggugugcaugaccaucgggauggccaaccugauccuccagaucggcaacaucauccugaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccucgcugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccucgcccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccuggaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22774 - RNA, 1410 nt, Artificial Sequence; identical to SEQ ID NO: 16318
  derived and/or modified CDS sequence (AUadapt) from InfluenzaA__ADX98821__NA

SEQ ID NO: 22775 - RNA, 1410 nt, Artificial Sequence; identical to SEQ ID NO: 16318
  derived and/or modified CDS sequence (AUadapt) from InfluenzaA__ADX98846__NA

SEQ ID NO: 22776 - RNA, 1410 nt, Artificial Sequence
  derived and/or modified CDS sequence (AUadapt) from InfluenzaA__ADX98856__NA
augaaccccaaccagaagaucaugaccaucggcucggugugcaugaccaucgggauggccaaccugauccuccagaucggcaacaucaucuccaucuggaucagccacuccauccagcuggggauccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22777 - RNA, 1410 nt, Artificial Sequence; identical to SEQ ID NO: 16318
  derived and/or modified CDS sequence (AUadapt) from InfluenzaA__ADX98863__NA

SEQ ID NO: 22778 - RNA, 1410 nt, Artificial Sequence; identical to SEQ ID NO: 16318
  derived and/or modified CDS sequence (AUadapt) from InfluenzaA__ADX98873__NA

SEQ ID NO: 22779 - RNA, 1410 nt, Artificial Sequence
  derived and/or modified CDS sequence (AUadapt) from InfluenzaA__ADX98883__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacgucgccgcgggccagucggugguguccgucaagcuggccgggaacagcucccucugcccggugagcggcugggccaucuacuccaaggacaacagcauccgcaucggcuccaagggggacgccuucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacucgcgguucgagagcguggcgugguccgccagcgccugccacgacgggaucaacuggcucaccaucggcaucuccggccccgacaacggggccguggcgguccugaaguacaacggcaucaucaccgacaccaucaagagcuggcgcaacaacauccugcggacgcaggaguccgagugcgccugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagucgaucagcucccggagcggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 22780 - RNA, 1410 nt, Artificial Sequence; identical to SEQ ID NO: 16318
  derived and/or modified CDS sequence (AUadapt) from InfluenzaA__ADX98893__NA

SEQ ID NO: 22781 - RNA, 1410 nt, Artificial Sequence; identical to SEQ ID NO: 16318
  derived and/or modified CDS sequence (AUadapt) from InfluenzaA__ADX98903__NA

SEQ ID NO: 22782 - RNA, 1410 nt, Artificial Sequence; identical to SEQ ID NO: 20693
  derived and/or modified CDS sequence (AUadapt) from InfluenzaA__ADX98913__NA

SEQ ID NO: 22783 - RNA, 1410 nt, Artificial Sequence; identical to SEQ ID NO: 20571
  derived and/or modified CDS sequence (AUadapt) from InfluenzaA__ADX98923__NA

SEQ ID NO: 22784 - RNA, 1410 nt, Artificial Sequence; identical to SEQ ID NO: 20577
  derived and/or modified CDS sequence (AUadapt) from InfluenzaA__ADX98933__NA

SEQ ID NO: 22785 - RNA, 1410 nt, Artificial Sequence; identical to SEQ ID NO: 16318
  derived and/or modified CDS sequence (AUadapt) from InfluenzaA__ADX98943__NA

SEQ ID NO: 22786 - RNA, 1410 nt, Artificial Sequence; identical to SEQ ID NO: 21097
  derived and/or modified CDS sequence (AUadapt) from InfluenzaA__ADX98953__NA

SEQ ID NO: 22787 - RNA, 1410 nt, Artificial Sequence; identical to SEQ ID NO: 16318
  derived and/or modified CDS sequence (AUadapt) from InfluenzaA__ADX98963__NA

SEQ ID NO: 22788 - RNA, 1410 nt, Artificial Sequence
  derived and/or modified CDS sequence (AUadapt) from InfluenzaA__ADX98973__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugaucugcccgaucggcgagguccccucgcccuacaacucccgguucgagagcguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgucggacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22789 - RNA, 1410 nt, Artificial Sequence; identical to SEQ ID NO: 16318
  derived and/or modified CDS sequence (AUadapt) from InfluenzaA__ADX98983__NA

SEQ ID NO: 22790 - RNA, 1410 nt, Artificial Sequence; identical to SEQ ID NO: 16318
  derived and/or modified CDS sequence (AUadapt) from InfluenzaA__ADX98993__NA

SEQ ID NO: 22791 - RNA, 1410 nt, Artificial Sequence; identical to SEQ ID NO: 16318
  derived and/or modified CDS sequence (AUadapt) from InfluenzaA__ADX99003__NA

SEQ ID NO: 22792 - RNA, 1365 nt, Artificial Sequence
  derived and/or modified CDS sequence (AUadapt) from InfluenzaA__ADX99584__NA
augaaucccaaccagaagaucaccaccaucggcucgaucugccugguggucgggcucaucucccugauccugcagaucggcaacaucaucagcaucuggaucucccacagcauccagacggggucccagaaccacaccggcaucugcaaccagaacaucaucaccuacaagaacucgaccugggugaaggacacgaccuccgugauccucaccgggaacagcucccuguguccgauccgcggcugggccaucuacagcaaggacaacuccauccggaucggcagcaagggggacgucuucgugauccgcgagcccuucaucuccugcucgcaccuggagugccggaccuucuuccucacgcagggcgcccugcugaacgacaagcacuccaacgggaccgugaaggaucgcagccccuaccgggcgcucauguccugccccgucggcgaggccccgagccccuacaacucccgcuucgagagcguggccuggucggccuccgccugccacgacgggaugggcuggcugaccaucggcaucagcgggcccgacaacggcgcgguggccguccugaaguacaacgggaucaucaccgagacgaucaaguccuggcggaagaagauccuccgcacccaggagagcgagugcgccugugugaacggcuccugcuucaccaucaugaccgacggccccagcgacgggcuggccuccuacaagaucuucaagaucgagaagggcaaggugaccaagucgaucgagcugaacgcgccgaacucccacuacgaggagugcagcugcuaccccgacacggggaaggucaugugugugugccgggacaacuggcacggcuccaaccgccccugggugagcuucgaccagaaccucgacuaccagaucggguacaucugcuccggcgucuucggcgacaacccccggccggaggacgggaccggcagcugcgggcccguguauguggacggcgccaacggggucaagggcuucuccuaccgcuacggcaacgggguguggaucggccggaccaagucgcacuccagccgccacggguucgagaugaucugggaccccaacggcuggacggagaccgacuccaaguucagcgugcggcaggacgucguggccaugaccgacuggaguggguacuccggcucguucgugcagcaccccgagcugaccggccuggacugcaugcgcccgugcuucugggucgagcucauccgggggcgccccaaggagaagacgaucuggaccuccgccagcuccaucagcuucugcggcgugaacuccgacaccgucgacuggagcuggcccgacggggccgagcugcccuucuccaucgacaaguga

SEQ ID NO: 22793 - RNA, 1365 nt, Artificial Sequence; identical to SEQ ID NO: 22792
  derived and/or modified CDS sequence (AUadapt) from InfluenzaA__ADX99595__NA

SEQ ID NO: 22794 - RNA, 1365 nt, Artificial Sequence; identical to SEQ ID NO: 22792
  derived and/or modified CDS sequence (AUadapt) from InfluenzaA__ADX99606__NA

SEQ ID NO: 22795 - RNA, 1365 nt, Artificial Sequence; identical to SEQ ID NO: 22792
  derived and/or modified CDS sequence (AUadapt) from InfluenzaA__ADX99617__NA

SEQ ID NO: 22796 - RNA, 1365 nt, Artificial Sequence; identical to SEQ ID NO: 22792
  derived and/or modified CDS sequence (AUadapt) from InfluenzaA__ADX99628__NA

SEQ ID NO: 22797 - RNA, 1365 nt, Artificial Sequence; identical to SEQ ID NO: 22792
  derived and/or modified CDS sequence (AUadapt) from InfluenzaA__ADX99639__NA

SEQ ID NO: 22798 - RNA, 1365 nt, Artificial Sequence; identical to SEQ ID NO: 16322
  derived and/or modified CDS sequence (AUadapt) from InfluenzaA__ADX99650__NA

SEQ ID NO: 22799 - RNA, 1365 nt, Artificial Sequence; identical to SEQ ID NO: 16322
  derived and/or modified CDS sequence (AUadapt) from InfluenzaA__ADX99672__NA

SEQ ID NO: 22800 - RNA, 1365 nt, Artificial Sequence; identical to SEQ ID NO: 16322
  derived and/or modified CDS sequence (AUadapt) from InfluenzaA__ADX99683__NA

SEQ ID NO: 22801 - RNA, 1365 nt, Artificial Sequence; identical to SEQ ID NO: 16322
  derived and/or modified CDS sequence (AUadapt) from InfluenzaA__ADX99694__NA

SEQ ID NO: 22802 - RNA, 1365 nt, Artificial Sequence; identical to SEQ ID NO: 16322
  derived and/or modified CDS sequence (AUadapt) from InfluenzaA__ADX99705__NA

SEQ ID NO: 22803 - RNA, 1365 nt, Artificial Sequence; identical to SEQ ID NO: 16322
  derived and/or modified CDS sequence (AUadapt) from InfluenzaA__ADX99846__NA

SEQ ID NO: 22804 - RNA, 1365 nt, Artificial Sequence; identical to SEQ ID NO: 16322
  derived and/or modified CDS sequence (AUadapt) from InfluenzaA__ADX99857__NA

SEQ ID NO: 22805 - RNA, 1365 nt, Artificial Sequence; identical to SEQ ID NO: 16322
  derived and/or modified CDS sequence (AUadapt) from InfluenzaA__ADX99868__NA

SEQ ID NO: 22806 - RNA, 1365 nt, Artificial Sequence; identical to SEQ ID NO: 16322
  derived and/or modified CDS sequence (AUadapt) from InfluenzaA__ADX99879__NA

SEQ ID NO: 22807 - RNA, 1365 nt, Artificial Sequence; identical to SEQ ID NO: 16322
  derived and/or modified CDS sequence (AUadapt) from InfluenzaA__ADX99890__NA

SEQ ID NO: 22808 - RNA, 1365 nt, Artificial Sequence; identical to SEQ ID NO: 16322
  derived and/or modified CDS sequence (AUadapt) from InfluenzaA__ADX99901__NA

SEQ ID NO: 22809 - RNA, 1365 nt, Artificial Sequence
  derived and/or modified CDS sequence (AUadapt) from InfluenzaA__ADX99912__NA
augaaucccaaccagaagaucaucaccaucggcucgaucugccugguggucgggcucaucucccugauccugcagaucggcaacaucaucagcaucuggaucucccacagcauccagaccgggucccagaaccacacgggcaucugcaaccagaacaucaucaccuacaagaacagcaccugggugaaggacaccacguccgugauccucaccgggaacucgucccugugcccgauccgcggcugggccaucuacagcaaggauaacuccauccggaucggcagcaagggggacgucuucaucauccgcgagcccuucaucuccugcagccaccuggagugccggaccuucuuccucacccagggcgcccugcugaacgacaagcacuccucggggacggugaaggaccgcucccccuaccgggcgcucaugagcugccccgugggcgaggccccgucccccuacaacagccgcuuugagagcgucgccugguccgccucggccugccacgacgggaugggcuggcugaccaucggcaucuccgggcccgacaacggcgcgguggccgugcugaaguacaacgggaucaucaccgagaccaucaagagcuggcggaagaagauccuccgcacgcaggaguccgagugcgccugcgucaacggcagcugcuucaccaucaugaccgacggccccuccgacgggcuggccagcuacaagaucuucaagaucgagaagggcaaggugaccaaguccaucgagcugaacgcgccgaauucgcacuacgaggagugcuccugcuaccccgacacggggaaggugaugugcgucugccgggacaacuggcacggcagcaaccgccccuggguguccuucgaccagaaccucgacuaccagaucggguacaucugcaguggcguguucggcgacaacccccggccggaggacgggaccggcuccugcgggcccgucuacguggacggcgccaacggggugaagggcuucagcuaccgcuacggcaacggggucuggaucggccggaccaagucccacucgucccgccacggguucgagaugaucugggaccccaacggcuggaccgagacggacagcaaguucagugugcggcaggacguggucgccaugaccgacugguccggguacagcggcuccuucgugcagcaccccgagcugaccggccuggacugcaugcgcccgugcuucuggguggagcucauccgggggcgccccaaggagaagaccaucuggacgucggccuccagcaucuccuucugcggcgucaacagcgacaccguggacugguccuggcccgacggggccgagcugcccuucagcaucgacaaguga

SEQ ID NO: 22810 - RNA, 1365 nt, Artificial Sequence; identical to SEQ ID NO: 16322
  derived and/or modified CDS sequence (AUadapt) from InfluenzaA__ADX99923__NA

SEQ ID NO: 22811 - RNA, 1365 nt, Artificial Sequence; identical to SEQ ID NO: 16322
  derived and/or modified CDS sequence (AUadapt) from InfluenzaA__ADX99934__NA

SEQ ID NO: 22812 - RNA, 1365 nt, Artificial Sequence; identical to SEQ ID NO: 16322
  derived and/or modified CDS sequence (AUadapt) from InfluenzaA__ADX99956__NA

SEQ ID NO: 22813 - RNA, 1365 nt, Artificial Sequence; identical to SEQ ID NO: 16322
  derived and/or modified CDS sequence (AUadapt) from InfluenzaA__ADX99967__NA

SEQ ID NO: 22814 - RNA, 1365 nt, Artificial Sequence; identical to SEQ ID NO: 16322
  derived and/or modified CDS sequence (AUadapt) from InfluenzaA__ADX99978__NA

SEQ ID NO: 22815 - RNA, 1365 nt, Artificial Sequence; identical to SEQ ID NO: 16322
  derived and/or modified CDS sequence (AUadapt) from InfluenzaA__ADX99989__NA

SEQ ID NO: 22816 - RNA, 1365 nt, Artificial Sequence; identical to SEQ ID NO: 16322
  derived and/or modified CDS sequence (AUadapt) from InfluenzaA__ADY00001__NA

SEQ ID NO: 22817 - RNA, 1365 nt, Artificial Sequence; identical to SEQ ID NO: 16322
  derived and/or modified CDS sequence (AUadapt) from InfluenzaA__ADY00012__NA

SEQ ID NO: 22818 - RNA, 1365 nt, Artificial Sequence; identical to SEQ ID NO: 16322
  derived and/or modified CDS sequence (AUadapt) from InfluenzaA__ADY00023__NA

SEQ ID NO: 22819 - RNA, 1413 nt, Artificial Sequence
  derived and/or modified CDS sequence (AUadapt) from InfluenzaA__ADY04729__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcgugugcaaccagcgcaucaucaccuacgagaacuccaccugggucaaccacaccuacgugaacaucaacaacacgaacgugaucgcggggaaggacaagaccucggucaccauggccggcaacuccagccugugcuccaucagcggcugggccaucuacaccaaggacaacuccauccggaucgggucgaagggcgacguguucgugauccgcgagccguucaucuccugcagccaccuggagugccggacguucuuccucacccagggggcccugcugaacgacaagcacuccaacggcaccgucaaggaccgcucgcccuaccgggcccucauguccugcccccugggggaggcgcccagcccguacaacucgaaguucgaguccguggccuggagcgccuccgccugccacgacggcaugggcuggcugaccaucgggaucagcggccccgacaacggggcgguggccguccucaaguacaacggcaucaucacggagaccaucaaguccuggaagaagcagauccugcgcacccaggagucggagugcgugugcgugaacggcuccugcuucaccaucaugacggacgggcccagcaacggcgccgccuccuacaagaucuucaagaucgagaaggggaaggucaccaagucgaucgagcugaacgcccccaacuuccacuacgaggagugcuccugcuacccggacaccggcaccgugaugugcgugugccgggacaacuggcacgggagcaaccgccccugggucuccuucaaccagaaccucgacuaccagaucggcuacaucugcucgggcguguucggggacaacccccggcccaaggacggcgagggguccugcaacccggugacggucgacggcgcgaacggggugaagggcuucagcuacaaguacggcaacgggguguggaucggccgcaccaaguccaaccggcugcgcaagggguucgagaugaucugggaccccaacggcuggaccgacaccgacagcgacuucuccgucaagcaggacgugguggccaucacggacuggucgggguacagcggcuccuucguccagcaccccgagcugaccggccucgacugcauccggcccugcuucuggguggagcugguccgcgggcugccgaaggagaacaccaccaucuggacgucgggcuccagcaucuccuucugcggggugaacagcgacaccgccaacugguccuggcccgacggcgccgagcuccccuucaccaucgacaaguga

SEQ ID NO: 22820 - RNA, 1410 nt, Artificial Sequence; identical to SEQ ID NO: 21920
  derived and/or modified CDS sequence (AUadapt) from InfluenzaA__ADY11828__NA

SEQ ID NO: 22821 - RNA, 1410 nt, Artificial Sequence; identical to SEQ ID NO: 19001
  derived and/or modified CDS sequence (AUadapt) from InfluenzaA__ADY11839__NA

SEQ ID NO: 22822 - RNA, 1410 nt, Artificial Sequence; identical to SEQ ID NO: 19001
  derived and/or modified CDS sequence (AUadapt) from InfluenzaA__ADY17657__NA

SEQ ID NO: 22823 - RNA, 1410 nt, Artificial Sequence; identical to SEQ ID NO: 19001
  derived and/or modified CDS sequence (AUadapt) from InfluenzaA__ADY17668__NA

SEQ ID NO: 22824 - RNA, 1410 nt, Artificial Sequence; identical to SEQ ID NO: 19001
  derived and/or modified CDS sequence (AUadapt) from InfluenzaA__ADY17679__NA

SEQ ID NO: 22825 - RNA, 1410 nt, Artificial Sequence; identical to SEQ ID NO: 19001
  derived and/or modified CDS sequence (AUadapt) from InfluenzaA__ADY17690__NA

SEQ ID NO: 22826 - RNA, 1410 nt, Artificial Sequence; identical to SEQ ID NO: 19001
  derived and/or modified CDS sequence (AUadapt) from InfluenzaA__ADY17701__NA

SEQ ID NO: 22827 - RNA, 1410 nt, Artificial Sequence; identical to SEQ ID NO: 16318
  derived and/or modified CDS sequence (AUadapt) from InfluenzaA__ADY38722__NA

SEQ ID NO: 22828 - RNA, 1410 nt, Artificial Sequence; identical to SEQ ID NO: 20889
  derived and/or modified CDS sequence (AUadapt) from InfluenzaA__ADY38723__NA

SEQ ID NO: 22829 - RNA, 1410 nt, Artificial Sequence; identical to SEQ ID NO: 16318
  derived and/or modified CDS sequence (AUadapt) from InfluenzaA__ADY38734__NA

SEQ ID NO: 22830 - RNA, 1410 nt, Artificial Sequence; identical to SEQ ID NO: 20732
  derived and/or modified CDS sequence (AUadapt) from InfluenzaA__ADY38753__NA

SEQ ID NO: 22831 - RNA, 1410 nt, Artificial Sequence; identical to SEQ ID NO: 16318
  derived and/or modified CDS sequence (AUadapt) from InfluenzaA__ADY38763__NA

SEQ ID NO: 22832 - RNA, 1410 nt, Artificial Sequence; identical to SEQ ID NO: 16318
  derived and/or modified CDS sequence (AUadapt) from InfluenzaA__ADZ04600__NA

SEQ ID NO: 22833 - RNA, 1410 nt, Artificial Sequence; identical to SEQ ID NO: 16318
  derived and/or modified CDS sequence (AUadapt) from InfluenzaA__ADZ04610__NA

SEQ ID NO: 22834 - RNA, 1410 nt, Artificial Sequence; identical to SEQ ID NO: 16318
  derived and/or modified CDS sequence (AUadapt) from InfluenzaA__ADZ04693__NA

SEQ ID NO: 22835 - RNA, 1410 nt, Artificial Sequence; identical to SEQ ID NO: 16318
  derived and/or modified CDS sequence (AUadapt) from InfluenzaA__ADZ04701__NA

SEQ ID NO: 22836 - RNA, 1410 nt, Artificial Sequence; identical to SEQ ID NO: 16318
  derived and/or modified CDS sequence (AUadapt) from InfluenzaA__ADZ04711__NA

SEQ ID NO: 22837 - RNA, 1410 nt, Artificial Sequence
  derived and/or modified CDS sequence (AUadapt) from InfluenzaA__ADZ05393__NA
augaaccccaaccagaagaucaucaccaucgacucggugugcaugaccaucggcauggccaaccugauccuccagaucgggaacaucaucuccaucuggaucagccacuccauccagcugggcaaccagaaccagaucgagacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcgggugggccaucuacuccaaggacaacagcgugcgcaucggcuccaagggcgacguguucgucauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggaggugcccucccccuacaacagccgguucgagagcguggccugguccgcgagcgccugccacgacggcaucaacuggcucaccaucgggaucuccggccccgacaacggcgccgucgccgugcugaaguacaacgggaucaucaccgacaccaucaagagcuggcgcaacaacauccugcggacgcaggaguccgagugcgcgugcgugaacggcucgugcuucaccgucaugaccgacgggccguccaacggccaggccagcuacaagaucuuccgcaucgagaagggcaagaucgugaaguccguggagaugaacgcccccaacuaccacuacgaggagugcagcugcuaccccgacuccagcgagaucacgugcgucugccgggacaacuggcacggguccaaccgccccugggugucguucaaccagaaccucgaguaccagaucggcuacaucugcuccgggaucuucggcgacaacccgcggcccaacgacaagaccgggagcugcggccccguguccagcaacggcgccaacggggucaagggcuucuccuucaaguacgggaacggcguguggaucgggcgcaccaagagcaucagcucccggaacggcuucgagaugaucugggaccccaacggcuggaccgggaccgacaacaacuucucgaucaagcaggacaucgugggcaucaacgagugguccggguacagcggcuccuucguccagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 22838 - RNA, 1413 nt, Artificial Sequence
  derived and/or modified CDS sequence (AUadapt) from InfluenzaA__ADZ05837__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucacgugcgagaacuccaccugggugaaccacaccuacgucaacaucaacaacaccaacgugguggcgggggaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaccacggacuggagcggguacagcggcuccuucgugcagcaccccgagcucaccggccuggacugcauccggcccugcuucugggucgagcuggugcgcgggcucccgcgggagaacaccaccaucuggacgucgggcuccagcaucuccuucugcggggucaacagcgacaccgccaacugguccuggcccgacggcgccgagcugcccuucaccaucgacaaguga

SEQ ID NO: 22839 - RNA, 1413 nt, Artificial Sequence; identical to SEQ ID NO: 19863
  derived and/or modified CDS sequence (AUadapt) from InfluenzaA__ADZ05848__NA

SEQ ID NO: 22840 - RNA, 1410 nt, Artificial Sequence; identical to SEQ ID NO: 20307
  derived and/or modified CDS sequence (AUadapt) from InfluenzaA__ADZ05858__NA

SEQ ID NO: 22841 - RNA, 1410 nt, Artificial Sequence; identical to SEQ ID NO: 16318
  derived and/or modified CDS sequence (AUadapt) from InfluenzaA__ADZ47841__NA

SEQ ID NO: 22842 - RNA, 1410 nt, Artificial Sequence; identical to SEQ ID NO: 16318
  derived and/or modified CDS sequence (AUadapt) from InfluenzaA__ADZ47851__NA

SEQ ID NO: 22843 - RNA, 1410 nt, Artificial Sequence
  derived and/or modified CDS sequence (AUadapt) from InfluenzaA__ADZ47861__NA
augaaccccaaccagaagaucaucaccaucggcucggugugcaugaccaucgggcuggccaaccucauccugcagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacaucaacuucgccgcgggccagagcgucguguccgugaagcucgccgggaacagcucccugugcccggucucgggcugggccaucuacuccaaggacaacagcgugcgcaucggcuccaagggggacguguucgucauccgggagcccuucaucagcugcagcccccuggagugccgcacguucuuccucacccagggcgcccugcugaacgacaagcacuccaacgggaccaucaaggaccggucccccuaccgcacccucaugagcugcccgaucggcgaggugcccucccccuacaacagccgguucgagucgguggccugguccgcgagcgccugccacgacgggaucaacuggcugacgaucggcaucuccggccccgacaacggggccgucgccgugcugaaguacaacggcaucaucaccgacaccaucaagagcuggcgcaacaacauccuccggacccaggaguccgagugcgcgugcgugaacgggagcugcuucacggucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccuggaguaccggaucggguacaucugcuccggcaucuucggggacaacccgcgccccaacgacaagaccggcagcugcggccccguguccagcaacggggccaacggcgucaagggguucuccuucaaguacggcaacgggguguggaucggccggaccaagagcaucucgucccgcaacggcuucgagaugaucugggaccccaacggguggaccggcaccgacaagaacuucagcaucaagcaggacaucguggggaucaacgagugguccggcuacagcggguccuucguccagcacccggagcugaccggccucgacugcauccggcccugcuucuggguggagcugauccgcggccggcccaaggagaacacgaucuggaccagcggguccagcaucuccuucugcggcgucaacagcgacaccguggggugguccuggcccgacggcgccgagcugccguucaccaucgacaaguga

SEQ ID NO: 22844 - RNA, 1413 nt, Artificial Sequence
  derived and/or modified CDS sequence (AUadapt) from InfluenzaA__ADZ53101__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaaggugguggcgggggaggacaagaccagcgucacccuggccggcaacuccucgcugugcuccaucagcggcugggccaucaacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccucgaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcucgggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 22845 - RNA, 1410 nt, Artificial Sequence
  derived and/or modified CDS sequence (AUadapt) from InfluenzaA__ADZ53124__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuacuacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacgacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 22846 - RNA, 1410 nt, Artificial Sequence; identical to SEQ ID NO: 16318
  derived and/or modified CDS sequence (AUadapt) from InfluenzaA__ADZ53130__NA

SEQ ID NO: 22847 - RNA, 1410 nt, Artificial Sequence; identical to SEQ ID NO: 16274
  derived and/or modified CDS sequence (AUadapt) from InfluenzaA__ADZ53132__NA

SEQ ID NO: 22848 - RNA, 1410 nt, Artificial Sequence; identical to SEQ ID NO: 16318
  derived and/or modified CDS sequence (AUadapt) from InfluenzaA__ADZ53134__NA

SEQ ID NO: 22849 - RNA, 1410 nt, Artificial Sequence; identical to SEQ ID NO: 16318
  derived and/or modified CDS sequence (AUadapt) from InfluenzaA__ADZ53136__NA

SEQ ID NO: 22850 - RNA, 1410 nt, Artificial Sequence; identical to SEQ ID NO: 19494
  derived and/or modified CDS sequence (AUadapt) from InfluenzaA__ADZ53137__NA

SEQ ID NO: 22851 - RNA, 1410 nt, Artificial Sequence; identical to SEQ ID NO: 16318
  derived and/or modified CDS sequence (AUadapt) from InfluenzaA__ADZ53139__NA

SEQ ID NO: 22852 - RNA, 1410 nt, Artificial Sequence
  derived and/or modified CDS sequence (AUadapt) from InfluenzaA__ADZ53141__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacgacuucagcaucaagcaggacaucguggggaucaacgagugguccggcuacucgggguccuucgugcagcacagcgagcugacgggccuggacugcauccgcccgugcuucugggucgagcucauccggggccgccccaaggagaacaccaucuggaccuccgggagcuccaucagcuucugcggcgugaacuccgacaccgucggguggagcuggcccgacggcgccgagcugcccuucacgaucgacaaguga

SEQ ID NO: 22853 - RNA, 1410 nt, Artificial Sequence; identical to SEQ ID NO: 19001
  derived and/or modified CDS sequence (AUadapt) from InfluenzaA__AEA03712__NA

SEQ ID NO: 22854 - RNA, 1410 nt, Artificial Sequence; identical to SEQ ID NO: 19001
  derived and/or modified CDS sequence (AUadapt) from InfluenzaA__AEA03722__NA

SEQ ID NO: 22855 - RNA, 1410 nt, Artificial Sequence; identical to SEQ ID NO: 19001
  derived and/or modified CDS sequence (AUadapt) from InfluenzaA__AEA03744__NA

SEQ ID NO: 22856 - RNA, 1410 nt, Artificial Sequence
  derived and/or modified CDS sequence (AUadapt) from InfluenzaA__AEA03755__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 22857 - RNA, 1410 nt, Artificial Sequence; identical to SEQ ID NO: 19001
  derived and/or modified CDS sequence (AUadapt) from InfluenzaA__AEA03766__NA

SEQ ID NO: 22858 - RNA, 1410 nt, Artificial Sequence; identical to SEQ ID NO: 19001
  derived and/or modified CDS sequence (AUadapt) from InfluenzaA__AEA03796__NA

SEQ ID NO: 22859 - RNA, 1410 nt, Artificial Sequence; identical to SEQ ID NO: 19001
  derived and/or modified CDS sequence (AUadapt) from InfluenzaA__AEA03806__NA

SEQ ID NO: 22860 - RNA, 1410 nt, Artificial Sequence
  derived and/or modified CDS sequence (AUadapt) from InfluenzaA__AEA03817__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgaccgcugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 22861 - RNA, 1410 nt, Artificial Sequence; identical to SEQ ID NO: 19001
  derived and/or modified CDS sequence (AUadapt) from InfluenzaA__AEA03828__NA

SEQ ID NO: 22862 - RNA, 1410 nt, Artificial Sequence; identical to SEQ ID NO: 19001
  derived and/or modified CDS sequence (AUadapt) from InfluenzaA__AEA03838__NA

SEQ ID NO: 22863 - RNA, 1410 nt, Artificial Sequence; identical to SEQ ID NO: 22157
  derived and/or modified CDS sequence (AUadapt) from InfluenzaA__AEA03849__NA

SEQ ID NO: 22864 - RNA, 1410 nt, Artificial Sequence; identical to SEQ ID NO: 19001
  derived and/or modified CDS sequence (AUadapt) from InfluenzaA__AEA03860__NA

SEQ ID NO: 22865 - RNA, 1410 nt, Artificial Sequence
  derived and/or modified CDS sequence (AUadapt) from InfluenzaA__AEA03871__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaucaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 22866 - RNA, 1410 nt, Artificial Sequence; identical to SEQ ID NO: 19001
  derived and/or modified CDS sequence (AUadapt) from InfluenzaA__AEA03879__NA

SEQ ID NO: 22867 - RNA, 1410 nt, Artificial Sequence
  derived and/or modified CDS sequence (AUadapt) from InfluenzaA__AEA03889__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaagguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 22868 - RNA, 1410 nt, Artificial Sequence
  derived and/or modified CDS sequence (AUadapt) from InfluenzaA__AEA03898__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaaguccgacagcuccagcuccucgcacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 22869 - RNA, 1410 nt, Artificial Sequence; identical to SEQ ID NO: 19001
  derived and/or modified CDS sequence (AUadapt) from InfluenzaA__AEA03909__NA

SEQ ID NO: 22870 - RNA, 1410 nt, Artificial Sequence
  derived and/or modified CDS sequence (AUadapt) from InfluenzaA__AEA03924__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucauccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 22871 - RNA, 1410 nt, Artificial Sequence; identical to SEQ ID NO: 19001
  derived and/or modified CDS sequence (AUadapt) from InfluenzaA__AEA03935__NA

SEQ ID NO: 22872 - RNA, 1410 nt, Artificial Sequence
  derived and/or modified CDS sequence (AUadapt) from InfluenzaA__AEA03946__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccgaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 22873 - RNA, 1410 nt, Artificial Sequence
  derived and/or modified CDS sequence (AUadapt) from InfluenzaA__AEA03957__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaacuccaagucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggcccgacggcgccgacaucaaccugaugccgaucuga

SEQ ID NO: 22874 - RNA, 1410 nt, Artificial Sequence; identical to SEQ ID NO: 19001
  derived and/or modified CDS sequence (AUadapt) from InfluenzaA__AEA03989__NA

SEQ ID NO: 22875 - RNA, 1410 nt, Artificial Sequence; identical to SEQ ID NO: 22157
  derived and/or modified CDS sequence (AUadapt) from InfluenzaA__AEA04000__NA

SEQ ID NO: 22876 - RNA, 1410 nt, Artificial Sequence; identical to SEQ ID NO: 19001
  derived and/or modified CDS sequence (AUadapt) from InfluenzaA__AEA04011__NA

SEQ ID NO: 22877 - RNA, 1410 nt, Artificial Sequence; identical to SEQ ID NO: 22157
  derived and/or modified CDS sequence (AUadapt) from InfluenzaA__AEA04022__NA

SEQ ID NO: 22878 - RNA, 1410 nt, Artificial Sequence; identical to SEQ ID NO: 19001
  derived and/or modified CDS sequence (AUadapt) from InfluenzaA__AEA04033__NA

SEQ ID NO: 22879 - RNA, 1410 nt, Artificial Sequence; identical to SEQ ID NO: 19001
  derived and/or modified CDS sequence (AUadapt) from InfluenzaA__AEA04044__NA

SEQ ID NO: 22880 - RNA, 1410 nt, Artificial Sequence; identical to SEQ ID NO: 19001
  derived and/or modified CDS sequence (AUadapt) from InfluenzaA__AEA04049__NA

SEQ ID NO: 22881 - RNA, 1410 nt, Artificial Sequence; identical to SEQ ID NO: 19001
  derived and/or modified CDS sequence (AUadapt) from InfluenzaA__AEA04059__NA

SEQ ID NO: 22882 - RNA, 1410 nt, Artificial Sequence; identical to SEQ ID NO: 19001
  derived and/or modified CDS sequence (AUadapt) from InfluenzaA__AEA04070__NA

SEQ ID NO: 22883 - RNA, 1410 nt, Artificial Sequence; identical to SEQ ID NO: 22157
  derived and/or modified CDS sequence (AUadapt) from InfluenzaA__AEA04081__NA

SEQ ID NO: 22884 - RNA, 1410 nt, Artificial Sequence; identical to SEQ ID NO: 19001
  derived and/or modified CDS sequence (AUadapt) from InfluenzaA__AEA04092__NA

SEQ ID NO: 22885 - RNA, 1410 nt, Artificial Sequence; identical to SEQ ID NO: 19001
  derived and/or modified CDS sequence (AUadapt) from InfluenzaA__AEA04103__NA

SEQ ID NO: 22886 - RNA, 1410 nt, Artificial Sequence; identical to SEQ ID NO: 19001
  derived and/or modified CDS sequence (AUadapt) from InfluenzaA__AEA04125__NA

SEQ ID NO: 22887 - RNA, 1410 nt, Artificial Sequence; identical to SEQ ID NO: 19001
  derived and/or modified CDS sequence (AUadapt) from InfluenzaA__AEA04133__NA

SEQ ID NO: 22888 - RNA, 1410 nt, Artificial Sequence
  derived and/or modified CDS sequence (AUadapt) from InfluenzaA__AEA04144__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucauccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucaucguguucugcggcaccuccgggacguacggcaccgggagcuggccggacggcgccgacaucaaccugaugcccaucuga

SEQ ID NO: 22889 - RNA, 1410 nt, Artificial Sequence; identical to SEQ ID NO: 19001
  derived and/or modified CDS sequence (AUadapt) from InfluenzaA__AEA04155__NA

SEQ ID NO: 22890 - RNA, 1410 nt, Artificial Sequence; identical to SEQ ID NO: 19001
  derived and/or modified CDS sequence (AUadapt) from InfluenzaA__AEA04166__NA

SEQ ID NO: 22891 - RNA, 1410 nt, Artificial Sequence
  derived and/or modified CDS sequence (AUadapt) from InfluenzaA__AEA04177__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 22892 - RNA, 1410 nt, Artificial Sequence; identical to SEQ ID NO: 19001
  derived and/or modified CDS sequence (AUadapt) from InfluenzaA__AEA04188__NA

SEQ ID NO: 22893 - RNA, 1410 nt, Artificial Sequence; identical to SEQ ID NO: 19994
  derived and/or modified CDS sequence (AUadapt) from InfluenzaA__AEA04199__NA

SEQ ID NO: 22894 - RNA, 1410 nt, Artificial Sequence; identical to SEQ ID NO: 19001
  derived and/or modified CDS sequence (AUadapt) from InfluenzaA__AEA04210__NA

SEQ ID NO: 22895 - RNA, 1410 nt, Artificial Sequence; identical to SEQ ID NO: 19994
  derived and/or modified CDS sequence (AUadapt) from InfluenzaA__AEA04229__NA

SEQ ID NO: 22896 - RNA, 1410 nt, Artificial Sequence; identical to SEQ ID NO: 19994
  derived and/or modified CDS sequence (AUadapt) from InfluenzaA__AEA04239__NA

SEQ ID NO: 22897 - RNA, 1410 nt, Artificial Sequence
  derived and/or modified CDS sequence (AUadapt) from InfluenzaA__AEA04250__NA
augaaccccaaccagaagaucaucaccaucggcucggugucccugaccaucagcacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacaacaccguccgcgugcggaccccguaccgcacgcugcucaugaacgagcugggcgugcccuuccaccugggcaccaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacgcaggagagcgagugcgugugcaucaacgggaccugcaccgucgugaugaccgacggguccgccucgggcaaggccgacacgaagauccucuucaucgaggagggcaagaucgugcacaccagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcggccacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcacguccgggaccuacggcaccgggagcuggccggacggcgccgacaucaaccugaugcccaucuga

SEQ ID NO: 22898 - RNA, 1410 nt, Artificial Sequence; identical to SEQ ID NO: 19994
  derived and/or modified CDS sequence (AUadapt) from InfluenzaA__AEA04260__NA

SEQ ID NO: 22899 - RNA, 1410 nt, Artificial Sequence
  derived and/or modified CDS sequence (AUadapt) from InfluenzaA__AEA04268__NA
augaaccccaaccagaagaucaucaccaucggcucggugucccugaccaucucgacgaucugccucuucaugcagaccgccauccugaucaccaccgucacgcugcacuucaagcagugcgaguucaacuccccgcccaacaaccaggccaugcucugcgagcccaccaucaucgagcgcaacaucaccgagaucguguaccugaccaacacgaccaucgagaaggagaucugccccaagcuggcggaguaccggaacuggagcaagccgcagugcgacaucaccggguucgcccccuucuccaaggacaacucgauccgccucuccgccggcggggacaucugggugacccgggagcccuacgucagcugcgaccccgacaagugcuaccaguucgcccugggccaggggacgacccugaacaacgugcacuccaacaacaccgugcgcgaccggaccccguaccgcacgcuccugaugaacgagcugggcguccccuuccaccucggcaccaagcaggucugcaucgccuggucguccucguccugccacgacgggaaggcguggcugcacgugugcaucaccggcgacgacaagaacgccaccgccagcuucaucuacaacgggcggcugguggacuccguggugucgugguccaaggagauccuccgcacgcaggagagcgagugcgucugcaucaacgggaccugcaccguggugaugaccgacggguccgccucgggcaaggcggacacgaagauccuguucaucgaggagggcaagaucguccacaccucgacccuguccgggagcgcccagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccucgugggcgacacgccccggaagaacgacuccucguccagcucccacugccuggaccccaacaacgaggagggcggccacggggugaagggcugggccuucgacgacgggaacgacgucuggaugggccgcaccaucucggagaagucccggcugggcuacgagaccuucaaggugaucgagggguggagcaaccccaaguccaagcuccagaucaaccgccaggucaucguggaccggggcaaccgcucgggguacuccggcaucuucucgguggagggcaagagcugcaucaaccggugcuucuacgucgagcugauccgcgggcggaaggaggagaccgaggugcuguggaccuccaacucgaucguggucuucugcggcacguccgggaccuacggcaccgggagcuggccggacggcgccgacaucaaccucaugcccaucuga

SEQ ID NO: 22900 - RNA, 1410 nt, Artificial Sequence; identical to SEQ ID NO: 19994
  derived and/or modified CDS sequence (AUadapt) from InfluenzaA__AEA04276__NA

SEQ ID NO: 22901 - RNA, 1410 nt, Artificial Sequence; identical to SEQ ID NO: 19994
  derived and/or modified CDS sequence (AUadapt) from InfluenzaA__AEA04287__NA

SEQ ID NO: 22902 - RNA, 1410 nt, Artificial Sequence; identical to SEQ ID NO: 19994
  derived and/or modified CDS sequence (AUadapt) from InfluenzaA__AEA04298__NA

SEQ ID NO: 22903 - RNA, 1410 nt, Artificial Sequence
  derived and/or modified CDS sequence (AUadapt) from InfluenzaA__AEA04307__NA
augaaccccaaccagaagaucaucaccaucggcucggugucccugaccaucucgacgaucugcuucuucaugcagaccgccauccucaucaccaccgucacgcugcacuucaagcagugcgaguucaacuccccgcccaacaaccaggugaugcugugcgagcccaccaucaucgagcgcaacaucaccgagaucguguaccucaccaacacgaccaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggacgacccugaacaacgugcacuccaacaacaccguccgcgaccggaccccguaccgcacgcugcucaugaacgagcugggcgugcccuuccaccugggcaccaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacgcaggagucggagugcgugugcaucaacgggaccugcaccguggucaugaccgacggcuccgccagcggcaaggccgacacgaagauccucuucaucgaggagggcaagaucgugcacaccucgacccuguccgggagcgcgcagcacguggaggagugcuccugcuacccccgguaccccgacguccgcugcgugugccgggacaacuggaagggcucgaaccgcccgaucguggacaucaacaucaaggaccacuccaucgucagcuccuacgugugcucggggcuggugggcgacacgccccggaagaacgacuccagcuccucgucccacugccucgaccccaacaacgaggagggcgggcacggcgucaaggggugggccuucgacgacggcaacgacguguggauggggcgcaccaucagcgagaagucccggcugggcuacgagaccuucaaggucaucgagggcuggucgaaccccaaguccaagcugcagaucaaccgccaggugaucguggaccgggggaaccgcagcggcuacuccgggaucuucucggucgagggcaagagcugcaucaaccggugcuucuacguggagcucauccgcgggcggaaggaggagaccgaggugcuguggaccuccaacucgaucgucguguucugcggcacguccggcaccuacgggaccggcagcuggccggacggggccgacaucaaccugaugcccaucuga

SEQ ID NO: 22904 - RNA, 1395 nt, Artificial Sequence
  derived and/or modified CDS sequence (AUadapt) from InfluenzaA__AEA04357__NA
augaaccccaaccagaagaucaucaccaucggcucgaucugcaugguggucgggaucaucucccugauccuccagaucggcaacaucgugagcaucuggaucucccacucgauccagaccgggaaccagaaccacacggggaccugcgaccaguccaucaucaccuacaagaacagcaccugggugaaccagacguacgucaacgugguggccggcaaggacaccaccuccgucauccuggccggcaacagcucccugugcccgauccgcggcugggcgaucuacucgaaggacaacggggugcggaucggcuccaagggggacguguucgucauccgcgagcccuucaucagcugcucccaccucgagugccggaccuucuuccugacgcagggcgcccugcucaacgacaagcacagcaacgggaccgugaaggaccgcucccccuaccgggcccugaugucgugccccgugggcgaggccccgucccccuacaacagccgcuucgaguccgucgccuggagcgcgucggccugccacgacggcaugggguggcugaccaucggcaucuccgggcccgacgacggcgccguggccgugcucaaguacaacggcaucaucaccgagacgaucaagagcuggcggaaggagauccugcgcacccaggaguccgagugcgucugcgugaacgggagcugcuucaccaucaugaccgacggccccuccgggggcccggcgucguacaagaucuucaagaucgagaaggggaaggugacgaaguccaucgagcuggacgcccccaacagccacuacgaggagugcuccugcuaccccgacaccagcaaggucaugugcgugugccgggacaacuggcacggcuccaaccgccccugggugucguucgaccagaaccucgacuaccagaugggcuacaucugcuccggggucuucggcgacaacccgcggcccaaggacgggaagggcagcugcgggcccguguacguggacggcgccaacggcgucaagggguucuccuacaaguacggcaacgggguguggaucggccgcaccaagagcaucuccucgcggcagggguucgagaugaucugggaccccaacggcuggaccgagacggacuccaacuucuucaccaagcaggacgucguggccgugaccgacuggagcggcuacagcggguccuucguccagcacccggagcugaccggccuggacugcaugcgccccugcuucuggguggagcucauccgggggcgccccaaggagaacacgaucuggaccucgggcuccagcaucuccuucugcggcgugaacagcgacaccgucgacugguccuggcccgacggggccgagcugccguucaccaucgacaaguga

SEQ ID NO: 22905 - RNA, 1410 nt, Artificial Sequence; identical to SEQ ID NO: 18869
  derived and/or modified CDS sequence (AUadapt) from InfluenzaA__AEA04368__NA

SEQ ID NO: 22906 - RNA, 1410 nt, Artificial Sequence
  derived and/or modified CDS sequence (AUadapt) from InfluenzaA__AEA04379__NA
augaaccccaaccagaagaccaucaccaucggcucggugucccugacgaucgagaccgucugcuuccucaugcagaucgccauccuggccaccaccgugacgcugcacuucaagcagcacgagugcgacucgccggcguccaaccaggugaugcccugcgagcccaucaucaucgagcgcaacaucaccgagaucgucuaccucaacaacaccaccaucgagaaggagaucugccccgaggugguggaguaccggaacuggucgaagccgcagugccagaucacgggguucgcccccuucuccaaggacaacagcauccgccuguccgccggcggggacaucugggucacccgggagcccuacgugucgugcgaccccggcaagugcuaccaguucgcccuggggcagggcaccacccucgacaacaagcacuccaacggcacgauccacgaccgcaucccgcaccggacccugcugaugaacgagcucggggugcccuuccaccugggcaccaagcaggucugcguggccuggucguccagcuccugccacgacgggaaggcguggcugcacgugugcgucaccggcgacgaccgcaacgccacggccucguucaucuacgacgggcggcucguggacuccaucggcucguggucccagaacauccugcgcacccaggagagcgagugcgugugcaucaacgggaccugcaccgucgugaugacggacggcuccgccucgggccgggcggacacccgcauccuguucaucaaggaggggaagaucgugcacaucucgccccucuccggcagcgcccagcacaucgaggagugcuccugcuacccccgguacccggacguccgcugcaucugccgggacaacuggaagggcucgaaccgccccgugaucgacaucaacauggaggacuacuccaucgacucguccuacgugugcucggggcuggucggcgacacgccccggaacgacgacuccagcuccaacucgaagucccgcgaccccaacaacgagcgggggaacccgggcgugaaggggugggccuucgacaacggcgacgacguguggaugggccgcaccaucucgaaggacucccggagcggguacgagaccuucaaggucaucggcgggugguccacccccaacucgaagucccaggugaaccgccaggucaucguggacaacaacaacuggucgggcuacagcgggaucuucuccguggagggcaagucgugcaucaaccggugcuucuacgucgagcugauccgcggccgcccccaggagacccgggugugguggaccuccaacucgaucguggucuucugcgggacguccggcaccuacgggaccggcagcuggcccgacggggccaacaucaacuucaugccgaucuga

SEQ ID NO: 22907 - RNA, 1413 nt, Artificial Sequence; identical to SEQ ID NO: 22606
  derived and/or modified CDS sequence (AUadapt) from InfluenzaA__AEA10295__NA

SEQ ID NO: 22908 - RNA, 1410 nt, Artificial Sequence; identical to SEQ ID NO: 16318
  derived and/or modified CDS sequence (AUadapt) from InfluenzaA__AEA10306__NA

SEQ ID NO: 22909 - RNA, 1410 nt, Artificial Sequence; identical to SEQ ID NO: 22493
  derived and/or modified CDS sequence (AUadapt) from InfluenzaA__AEA10316__NA

SEQ ID NO: 22910 - RNA, 1410 nt, Artificial Sequence; identical to SEQ ID NO: 16318
  derived and/or modified CDS sequence (AUadapt) from InfluenzaA__AEA10326__NA

SEQ ID NO: 22911 - RNA, 1410 nt, Artificial Sequence; identical to SEQ ID NO: 20428
  derived and/or modified CDS sequence (AUadapt) from InfluenzaA__AEA10335__NA

SEQ ID NO: 22912 - RNA, 1410 nt, Artificial Sequence; identical to SEQ ID NO: 16318
  derived and/or modified CDS sequence (AUadapt) from InfluenzaA__AEA10342__NA

SEQ ID NO: 22913 - RNA, 1410 nt, Artificial Sequence
  derived and/or modified CDS sequence (AUadapt) from InfluenzaA__AEA10352__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcaucaacgggucgugcuucaccgugaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcucgugcucccccgucagcuccaacggcgccaacggggugaagggcuucagcuucaaguacgggaacggcguguggaucgggcgcaccaagagcaucuccagccggaacggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccgccccugcuucuggguggagcucauccggggccgccccaaggagaacaccaucuggaccuccggcagcuccaucagcuucugcggggucaacuccgacaccgugggcuggagcuggcccgacggggccgagcugccguucacgaucgacaaguga

SEQ ID NO: 22914 - RNA, 1410 nt, Artificial Sequence; identical to SEQ ID NO: 16318
  derived and/or modified CDS sequence (AUadapt) from InfluenzaA__AEA48991__NA

SEQ ID NO: 22915 - RNA, 1410 nt, Artificial Sequence; identical to SEQ ID NO: 21812
  derived and/or modified CDS sequence (AUadapt) from InfluenzaA__AEA72707__NA

SEQ ID NO: 22916 - RNA, 1410 nt, Artificial Sequence; identical to SEQ ID NO: 21812
  derived and/or modified CDS sequence (AUadapt) from InfluenzaA__AEA72718__NA

SEQ ID NO: 22917 - RNA, 1410 nt, Artificial Sequence; identical to SEQ ID NO: 21812
  derived and/or modified CDS sequence (AUadapt) from InfluenzaA__AEA72729__NA

SEQ ID NO: 22918 - RNA, 1410 nt, Artificial Sequence
  derived and/or modified CDS sequence (AUadapt) from InfluenzaA__AEA72742__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaacggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 22919 - RNA, 1410 nt, Artificial Sequence; identical to SEQ ID NO: 21415
  derived and/or modified CDS sequence (AUadapt) from InfluenzaA__AEA72779__NA

SEQ ID NO: 22920 - RNA, 1410 nt, Artificial Sequence
  derived and/or modified CDS sequence (AUadapt) from InfluenzaA__AEA72789__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacgacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 22921 - RNA, 1410 nt, Artificial Sequence; identical to SEQ ID NO: 21812
  derived and/or modified CDS sequence (AUadapt) from InfluenzaA__AEA73291__NA

SEQ ID NO: 22922 - RNA, 1410 nt, Artificial Sequence; identical to SEQ ID NO: 21812
  derived and/or modified CDS sequence (AUadapt) from InfluenzaA__AEA73302__NA

SEQ ID NO: 22923 - RNA, 1410 nt, Artificial Sequence; identical to SEQ ID NO: 21812
  derived and/or modified CDS sequence (AUadapt) from InfluenzaA__AEA73313__NA

SEQ ID NO: 22924 - RNA, 1410 nt, Artificial Sequence; identical to SEQ ID NO: 21812
  derived and/or modified CDS sequence (AUadapt) from InfluenzaA__AEA73324__NA

SEQ ID NO: 22925 - RNA, 1410 nt, Artificial Sequence; identical to SEQ ID NO: 21812
  derived and/or modified CDS sequence (AUadapt) from InfluenzaA__AEA73335__NA

SEQ ID NO: 22926 - RNA, 1410 nt, Artificial Sequence; identical to SEQ ID NO: 21812
  derived and/or modified CDS sequence (AUadapt) from InfluenzaA__AEA73346__NA

SEQ ID NO: 22927 - RNA, 1410 nt, Artificial Sequence; identical to SEQ ID NO: 21812
  derived and/or modified CDS sequence (AUadapt) from InfluenzaA__AEA73357__NA

SEQ ID NO: 22928 - RNA, 1410 nt, Artificial Sequence; identical to SEQ ID NO: 21812
  derived and/or modified CDS sequence (AUadapt) from InfluenzaA__AEA73368__NA

SEQ ID NO: 22929 - RNA, 1410 nt, Artificial Sequence; identical to SEQ ID NO: 21812
  derived and/or modified CDS sequence (AUadapt) from InfluenzaA__AEA73379__NA

SEQ ID NO: 22930 - RNA, 1410 nt, Artificial Sequence; identical to SEQ ID NO: 21812
  derived and/or modified CDS sequence (AUadapt) from InfluenzaA__AEA73390__NA

SEQ ID NO: 22931 - RNA, 1410 nt, Artificial Sequence; identical to SEQ ID NO: 21812
  derived and/or modified CDS sequence (AUadapt) from InfluenzaA__AEA73401__NA

SEQ ID NO: 22932 - RNA, 1410 nt, Artificial Sequence; identical to SEQ ID NO: 21812
  derived and/or modified CDS sequence (AUadapt) from InfluenzaA__AEA73412__NA

SEQ ID NO: 22933 - RNA, 1410 nt, Artificial Sequence; identical to SEQ ID NO: 21812
  derived and/or modified CDS sequence (AUadapt) from InfluenzaA__AEA73423__NA

SEQ ID NO: 22934 - RNA, 1410 nt, Artificial Sequence; identical to SEQ ID NO: 21812
  derived and/or modified CDS sequence (AUadapt) from InfluenzaA__AEA73455__NA

SEQ ID NO: 22935 - RNA, 1410 nt, Artificial Sequence; identical to SEQ ID NO: 21812
  derived and/or modified CDS sequence (AUadapt) from InfluenzaA__AEA73466__NA

SEQ ID NO: 22936 - RNA, 1410 nt, Artificial Sequence
  derived and/or modified CDS sequence (AUadapt) from InfluenzaA__AEA73477__NA
augaaccccaaccagaagaucaucaccaucggcucggugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccaaggugcuguggaccucgaacuccaucgucguguucugcggcacgagcgggaccuacggcaccggguccuggccggacggcgccgaccugaaccucaugcccaucuga

SEQ ID NO: 22937 - RNA, 1410 nt, Artificial Sequence; identical to SEQ ID NO: 21812
  derived and/or modified CDS sequence (AUadapt) from InfluenzaA__AEA73488__NA

SEQ ID NO: 22938 - RNA, 1410 nt, Artificial Sequence
  derived and/or modified CDS sequence (AUadapt) from InfluenzaA__AEA73499__NA
augaaccccaaccagaagaucaucaccaucggcucggugucccugaccaucagcacgaucugcuucuucaugcagaucgccauccucaucaccaccgucacccugcacuucaagcaguacaaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgaucaacaacgugcacuccaacaacaccguccgcgaccggaccccguaccgcacccugcugaugaacgagcucggcgugcccuuccaccugggcacgaagcaggucugcaucgccuggagcuccucguccugccacgacgggaaggccuggcugcacgugugcaucaccggcgacgacaagaacgcgaccgccagcuucaucuacaacgggcggcucguggacuccguggucucgugguccaaggagauccugcgcacccaggagagcgagugcgugugcaucaacggcacgugcaccguggucaugaccgacggguccgccucgggcaaggccgacaccaagauccuguucaucgaggagggcaagaucgugcacacgagcacccucuccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcucggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcucuggaccucgaacuccaucgucguguucugcggcacgagcgggaccuacggcaccggguccuggccggacggcgccgaccugaaccugaugcccaucuga

SEQ ID NO: 22939 - RNA, 1410 nt, Artificial Sequence; identical to SEQ ID NO: 21812
  derived and/or modified CDS sequence (AUadapt) from InfluenzaA__AEA73510__NA

SEQ ID NO: 22940 - RNA, 1410 nt, Artificial Sequence; identical to SEQ ID NO: 21812
  derived and/or modified CDS sequence (AUadapt) from InfluenzaA__AEA73521__NA

SEQ ID NO: 22941 - RNA, 1410 nt, Artificial Sequence; identical to SEQ ID NO: 21812
  derived and/or modified CDS sequence (AUadapt) from InfluenzaA__AEA73532__NA

SEQ ID NO: 22942 - RNA, 1410 nt, Artificial Sequence; identical to SEQ ID NO: 21812
  derived and/or modified CDS sequence (AUadapt) from InfluenzaA__AEA73543__NA

SEQ ID NO: 22943 - RNA, 1410 nt, Artificial Sequence; identical to SEQ ID NO: 21812
  derived and/or modified CDS sequence (AUadapt) from InfluenzaA__AEA73554__NA

SEQ ID NO: 22944 - RNA, 1410 nt, Artificial Sequence; identical to SEQ ID NO: 21812
  derived and/or modified CDS sequence (AUadapt) from InfluenzaA__AEA73565__NA

SEQ ID NO: 22945 - RNA, 1413 nt, Artificial Sequence; identical to SEQ ID NO: 19863
  derived and/or modified CDS sequence (AUadapt) from InfluenzaA__AEA73576__NA

SEQ ID NO: 22946 - RNA, 1413 nt, Artificial Sequence; identical to SEQ ID NO: 19863
  derived and/or modified CDS sequence (AUadapt) from InfluenzaA__AEA73587__NA

SEQ ID NO: 22947 - RNA, 1413 nt, Artificial Sequence; identical to SEQ ID NO: 22606
  derived and/or modified CDS sequence (AUadapt) from InfluenzaA__AEA73598__NA

SEQ ID NO: 22948 - RNA, 1413 nt, Artificial Sequence; identical to SEQ ID NO: 19863
  derived and/or modified CDS sequence (AUadapt) from InfluenzaA__AEA73609__NA

SEQ ID NO: 22949 - RNA, 1413 nt, Artificial Sequence; identical to SEQ ID NO: 19863
  derived and/or modified CDS sequence (AUadapt) from InfluenzaA__AEA73620__NA

SEQ ID NO: 22950 - RNA, 1413 nt, Artificial Sequence
  derived and/or modified CDS sequence (AUadapt) from InfluenzaA__AEA73631__NA
augaaccccaaccagaagaucaucaccaucggcucgaucuccaucgccaucgggaucaucagccugaugcuccagaucggcaacaucaucuccaucugggccagccacuccauccagaccgggucgcagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccagccugugcuccaucucgggcugggccaucuacaccaaggacaacuccauccggaucgggagcaagggcgacguguucgugauccgcgagccguucaucuccugcagccaccucgagugccggacguucuuccugacccagggggcccugcucaacgacaagcacuccaacggcaccgucaaggaccgcucgcccuaccgggcccugauguccugcccccugggggaggcgcccagcccguacaacagcaaguucgaguccguggccuggagcgccuccgccugccacgacggcaugggcuggcucaccaucgggaucucgggccccgacaacggggcgguggccguccugaaguacaacggcaucaucacgggcaccaucaaguccuggaagaagcagauccugcgcacccaggagagcgagugcgugugcaugaacggguccugcuucaccaucaugacggacggccccagcaacaaggccgccuccuacaagaucuucaagaucgagaaggggaaggugaccaagucgaucgagcucaacgcccccaacuucuacuacgaggagugcuccugcuacccggacaccggcaucgucaugugcgugugccgggacaacuggcacgggagcaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucucguacaaguacggcaacgggguguggaucggccgcaucaaguccaaccggcugcgcaagggguucgagaugaucugggaccccaacggcuggacgaacaccgacagcgacuucuccgugaagcaggacgucguggccaucaccgacuggagcggguacucgggcuccuucgugcagcaccccgagcucaccggccuggacugcauccggcccugcuucugggucgagcuggugcgcgggcucccgcgggagaacacgaccaucuggaccagcggcuccagcaucuccuucugcggggucaacagcgacaccgccaacugguccuggcccgacggcgccgagcugcccuucacgaucgacaaguga

SEQ ID NO: 22951 - RNA, 1413 nt, Artificial Sequence
  derived and/or modified CDS sequence (AUadapt) from InfluenzaA__AEA73642__NA
augaaccccaaccagcgcaucaucaccaucggcucgaucuccaucgccaucgggaucaucagccugaugcuccagaucggcaacaucaucuccaucugggccucgcacuccauccagaccgggagccagaacaacacgggcaucugcaagcagcggaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccgcaucgggucgaagggcgacguguucgugauccgggagccguucaucuccugcagccaccucgagugccgcacguucuuccugacccagggggcccugcucaacgacaagcacuccaacggcaccgccaaggaccggagccccuaccgcgcgcugauguccugcccccugggggaggcccccucgccguacaacagcaaguucgaguccgucgccuggagcgccuccgcgugccacgacggcaugggcuggcucaccaucgggaucucgggccccgacaacggggccguggccgugcugaaguacaacggcaucaucacgggcaccaucaaguccuggaagaagcagauccugcggacccaggagagcgagugcgucugcaugaacggguccugcuucaccaucaugacggacggccccucgaacaaggccgccuccuacaagaucuucaagaucgagaaggggaaggugaccaagagcaucgagcucaacgcgcccaacuucuacuacgaggagugcuccugcuacccggacaccggcaucgugaugugcgucugccgcgacaacuggcacgggagcaaccggcccuggguguccuucaaccagaaccuggacuaccagaucggcuacaucugcucgggcguguucggggacaacccccgccccgaggacggcgagggguccugcaacccggucaccguggacggcgccaacggggugaagggcuucagcuacaaguacggcaacggggucuggcugggccggacgaaguccaaccgccuccggaagggguucgagaugaucugggaccccaacggcuggaccaacaccgacucggacuucuccgugaagcaggacguggucgccaucaccgacuggagcggguacagcggcuccuucgugcagcaccccgagcugacgggccuggacugcauccgccccugcuucuggguggagcucguccgggggcugccgcgcgagaacaccaccaucuggaccucgggcuccagcaucuccuucugcggggugaacagcgacacggccaacugguccuggcccgacggcgccgagcugcccuucaccaucgacaaguga

SEQ ID NO: 22952 - RNA, 1413 nt, Artificial Sequence; identical to SEQ ID NO: 19863
  derived and/or modified CDS sequence (AUadapt) from InfluenzaA__AEA73653__NA

SEQ ID NO: 22953 - RNA, 1413 nt, Artificial Sequence
  derived and/or modified CDS sequence (AUadapt) from InfluenzaA__AEA73664__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgaaggagaacaccaccaucuggaccucgggcuccagcaucuccuucugcggggucaacagcgacacggccaacugguccuggcccgacggcgccgagcugcccuucaccaucgacaaguga

SEQ ID NO: 22954 - RNA, 1413 nt, Artificial Sequence
  derived and/or modified CDS sequence (AUadapt) from InfluenzaA__AEA73675__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucuggaucgagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 22955 - RNA, 1413 nt, Artificial Sequence; identical to SEQ ID NO: 22606
  derived and/or modified CDS sequence (AUadapt) from InfluenzaA__AEA73686__NA

SEQ ID NO: 22956 - RNA, 1413 nt, Artificial Sequence
  derived and/or modified CDS sequence (AUadapt) from InfluenzaA__AEA73697__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacaucguggcgggggaggacaagaccagcgugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcguggagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccgugaacggcgcggacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcauccggcccugcuucugggucgagcuggugcgcgggcucccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 22957 - RNA, 1413 nt, Artificial Sequence; identical to SEQ ID NO: 22607
  derived and/or modified CDS sequence (AUadapt) from InfluenzaA__AEA73708__NA

SEQ ID NO: 22958 - RNA, 1413 nt, Artificial Sequence; identical to SEQ ID NO: 19863
  derived and/or modified CDS sequence (AUadapt) from InfluenzaA__AEA73719__NA

SEQ ID NO: 22959 - RNA, 1413 nt, Artificial Sequence; identical to SEQ ID NO: 19863
  derived and/or modified CDS sequence (AUadapt) from InfluenzaA__AEA73730__NA

SEQ ID NO: 22960 - RNA, 1413 nt, Artificial Sequence; identical to SEQ ID NO: 19863
  derived and/or modified CDS sequence (AUadapt) from InfluenzaA__AEA73741__NA

SEQ ID NO: 22961 - RNA, 1413 nt, Artificial Sequence; identical to SEQ ID NO: 19863
  derived and/or modified CDS sequence (AUadapt) from InfluenzaA__AEA73752__NA

SEQ ID NO: 22962 - RNA, 1413 nt, Artificial Sequence; identical to SEQ ID NO: 22606
  derived and/or modified CDS sequence (AUadapt) from InfluenzaA__AEA73763__NA

SEQ ID NO: 22963 - RNA, 1410 nt, Artificial Sequence; identical to SEQ ID NO: 16318
  derived and/or modified CDS sequence (AUadapt) from InfluenzaA__AEA73774__NA

SEQ ID NO: 22964 - RNA, 1410 nt, Artificial Sequence; identical to SEQ ID NO: 16318
  derived and/or modified CDS sequence (AUadapt) from InfluenzaA__AEA73784__NA

SEQ ID NO: 22965 - RNA, 1410 nt, Artificial Sequence; identical to SEQ ID NO: 16318
  derived and/or modified CDS sequence (AUadapt) from InfluenzaA__AEA73794__NA

SEQ ID NO: 22966 - RNA, 1410 nt, Artificial Sequence; identical to SEQ ID NO: 16318
  derived and/or modified CDS sequence (AUadapt) from InfluenzaA__AEA73804__NA

SEQ ID NO: 22967 - RNA, 1410 nt, Artificial Sequence; identical to SEQ ID NO: 16318
  derived and/or modified CDS sequence (AUadapt) from InfluenzaA__AEA73814__NA

SEQ ID NO: 22968 - RNA, 1410 nt, Artificial Sequence; identical to SEQ ID NO: 16318
  derived and/or modified CDS sequence (AUadapt) from InfluenzaA__AEA73824__NA

SEQ ID NO: 22969 - RNA, 1410 nt, Artificial Sequence
  derived and/or modified CDS sequence (AUadapt) from InfluenzaA__AEA73834__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggaagaacaacauccugcgcacgcaggaguccgagugcgcgugcgucaacgggucgugcuucaccgugaugaccgacggcccguccgacggccaggccagcuacaagaucuuccggaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugucguucaaccagaaccucgaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 22970 - RNA, 1410 nt, Artificial Sequence; identical to SEQ ID NO: 22502
  derived and/or modified CDS sequence (AUadapt) from InfluenzaA__AEA73844__NA

SEQ ID NO: 22971 - RNA, 1410 nt, Artificial Sequence; identical to SEQ ID NO: 16318
  derived and/or modified CDS sequence (AUadapt) from InfluenzaA__AEA73854__NA

SEQ ID NO: 22972 - RNA, 1410 nt, Artificial Sequence; identical to SEQ ID NO: 16318
  derived and/or modified CDS sequence (AUadapt) from InfluenzaA__AEA73864__NA

SEQ ID NO: 22973 - RNA, 1410 nt, Artificial Sequence; identical to SEQ ID NO: 20921
  derived and/or modified CDS sequence (AUadapt) from InfluenzaA__AEA73874__NA

SEQ ID NO: 22974 - RNA, 1410 nt, Artificial Sequence; identical to SEQ ID NO: 20921
  derived and/or modified CDS sequence (AUadapt) from InfluenzaA__AEA73884__NA

SEQ ID NO: 22975 - RNA, 1410 nt, Artificial Sequence; identical to SEQ ID NO: 22502
  derived and/or modified CDS sequence (AUadapt) from InfluenzaA__AEA73894__NA

SEQ ID NO: 22976 - RNA, 1410 nt, Artificial Sequence
  derived and/or modified CDS sequence (AUadapt) from InfluenzaA__AEA73904__NA
augaaccccaaccagaagaucaucaccaucggcucggugugcaugaccaucgggauggccaaccugguccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucaucgggaucaacgagugguccggcuacagcggguccuucgugcagcacccggagcugacgggccuggacugcauccgccccugcuucugggucgagcucauccggggccgccccaaggagaagaccaucuggaccagcggguccagcaucuccuucugcggcgugaacagcgacaccgucgggugguccuggcccgacggcgccgagcugccguucacgaucgacaaguga

SEQ ID NO: 22977 - RNA, 1410 nt, Artificial Sequence; identical to SEQ ID NO: 16318
  derived and/or modified CDS sequence (AUadapt) from InfluenzaA__AEA73914__NA

SEQ ID NO: 22978 - RNA, 1410 nt, Artificial Sequence; identical to SEQ ID NO: 20921
  derived and/or modified CDS sequence (AUadapt) from InfluenzaA__AEA73924__NA

SEQ ID NO: 22979 - RNA, 1410 nt, Artificial Sequence; identical to SEQ ID NO: 22579
  derived and/or modified CDS sequence (AUadapt) from InfluenzaA__AEA73934__NA

SEQ ID NO: 22980 - RNA, 1410 nt, Artificial Sequence
  derived and/or modified CDS sequence (AUadapt) from InfluenzaA__AEA73944__NA
augaaccccaaccagaagaucaucaccaucggcucggugugcaugaccaucgggauggccaaccugauccuccaggucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccgacggccaggccagcuacaagaucuuccgcaucgagaaggggaagaucgugaaguccguggagaugaacgcccccaacuacuacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 22981 - RNA, 1410 nt, Artificial Sequence; identical to SEQ ID NO: 16318
  derived and/or modified CDS sequence (AUadapt) from InfluenzaA__AEA73954__NA

SEQ ID NO: 22982 - RNA, 1410 nt, Artificial Sequence; identical to SEQ ID NO: 16318
  derived and/or modified CDS sequence (AUadapt) from InfluenzaA__AEA73964__NA

SEQ ID NO: 22983 - RNA, 1410 nt, Artificial Sequence
  derived and/or modified CDS sequence (AUadapt) from InfluenzaA__AEA73974__NA
augaaccccaaccagaagaucaucaccaucggcucggugugcaugaccaucgggauggccaaccugauccuccagaucggcaacaucaucuccaucuggaucagccacuccauccagcacgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccugugcccggucagcggcugggccaucuacuccaaggacaacagcauccgcaucggcuccaagggggacguguucgugauccgggagcccuucaucagcugcucgccccucgagugccgcaccuucuuccugacccagggcgcccugcucaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaucaagcaggacaucguggggaucaacgagugguccggcuacucgggguccuucgugcagcacccggagcucacgggccuggacugcauccgccccugcuucugggucgagcugauccggggccgccccaaggagaacaccaucuggaccagcggguccagcaucuccuucugcggcgugaacagcgacaccgucgggugguccuggcccgacggcgccgagcucccguucacgaucgacaaguga

SEQ ID NO: 22984 - RNA, 1410 nt, Artificial Sequence; identical to SEQ ID NO: 16318
  derived and/or modified CDS sequence (AUadapt) from InfluenzaA__AEA73984__NA

SEQ ID NO: 22985 - RNA, 1410 nt, Artificial Sequence; identical to SEQ ID NO: 20491
  derived and/or modified CDS sequence (AUadapt) from InfluenzaA__AEA73994__NA

SEQ ID NO: 22986 - RNA, 1410 nt, Artificial Sequence
  derived and/or modified CDS sequence (AUadapt) from InfluenzaA__AEA74004__NA
augaaccccaacaagaagaucaucaucaucggcucggugugcaugaccaucgggauggccaaccugauccuccagaucggcaacaucaucuccaucuggaucagccacuccauccagcuggggaaccagaaccagaucgagaccugcaaccagagcgucaucacguacgagaacaacaccugggugaaccagaccuacgugaacaucuccaacaccaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcacguucuuccugacccagggcgcccuccugaacgacaagcacuccaacgggaccaucaaggaccggucccccuaccgcacccugaugagcugcccgaucggcgagguccccucccccuacaacagccgguucgagucgguggccugguccgcgagcgccugccacgacgggaucaacuggcucacgaucggcaucuccggccccgacaacggggccguggccguccugaaguacaacggcaucaucaccgacaccaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 22987 - RNA, 1410 nt, Artificial Sequence; identical to SEQ ID NO: 20317
  derived and/or modified CDS sequence (AUadapt) from InfluenzaA__AEA74014__NA

SEQ ID NO: 22988 - RNA, 1410 nt, Artificial Sequence; identical to SEQ ID NO: 20317
  derived and/or modified CDS sequence (AUadapt) from InfluenzaA__AEA74024__NA

SEQ ID NO: 22989 - RNA, 1410 nt, Artificial Sequence; identical to SEQ ID NO: 16318
  derived and/or modified CDS sequence (AUadapt) from InfluenzaA__AEA74032__NA

SEQ ID NO: 22990 - RNA, 1410 nt, Artificial Sequence; identical to SEQ ID NO: 16318
  derived and/or modified CDS sequence (AUadapt) from InfluenzaA__AEA74034__NA

SEQ ID NO: 22991 - RNA, 1410 nt, Artificial Sequence
  derived and/or modified CDS sequence (AUadapt) from InfluenzaA__AEA77302__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaagugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacccccaagaagaacgacuccagcuccucgucccacugccucgaccccaacaacgaggagggcgggcacggggucaagggcugggccuucgacgacgggaacgacguguggaugggccggaccaucagcgagaagucccgccugggcuacgagacguucaaggucaucgagggguggucgaaccccaaguccaagcugcagaucaaccgccaggugaucguggaccggggcaaccggagcggguacuccggcaucuucucggucgagggcaagagcugcaucaaccgcugcuucuacguggagcucauccgggggcgcaaggaggagaccgaggugcuguggaccuccaacucgaucgucguguucugcggcaccuccgggacguacggcaccgggagcuggccggacggcgccgacaucaaccugaugcccaucuga

SEQ ID NO: 22992 - RNA, 1410 nt, Artificial Sequence; identical to SEQ ID NO: 22659
  derived and/or modified CDS sequence (AUadapt) from InfluenzaA__AEB21318__NA

SEQ ID NO: 22993 - RNA, 1410 nt, Artificial Sequence
  derived and/or modified CDS sequence (AUadapt) from InfluenzaA__AEB21328__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacggguucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggaucaacgaguggagcggcuacuccgggagcuucgugcagcacccggagcugacgggccuggacugcauccgccccugcuucuggguggagcucauccggggccgccccaaggagaacaccaucuggaccuccgggagcuccaugagcuucugcggcgucaacuccgacaccgugggguggagcuggcccgacggcgccgagcugccguucacgaucgacaaguga

SEQ ID NO: 22994 - RNA, 1410 nt, Artificial Sequence; identical to SEQ ID NO: 22659
  derived and/or modified CDS sequence (AUadapt) from InfluenzaA__AEB21340__NA

SEQ ID NO: 22995 - RNA, 1410 nt, Artificial Sequence
  derived and/or modified CDS sequence (AUadapt) from InfluenzaA__AEB21350__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagccccuccgagugccgcaccuucuuccugacccagggcgcccugcucaacgacaagcacucgaacgggaccaucaaggaccggucccccuaccgcacgcugaugagcugcccgaucggcgagguccccagccccuacaacucccgguucgagagcguggccugguccgcgagcgccugccacgacgggaucaacuggcugaccaucggcaucuccggccccgacaacggggccguggccguccucaaguacaacggcaucaucaccgacaccaucaagucguggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucagcuucaaguacggcaacgggguguggaucggccgcaccaaguccaucaucagccggaagggcuucgagaugaucugggaccccaacggguggaccggcaccgacaacaacuucuccaucaagcaggacaucgucgggaucaacgaguggucgggcuacuccgggagcuucgugcagcacccggagcucacgggccuggacugcauccgccccugcuucuggguggagcugauccggggccgccccaaggagaacaccaucuggaccuccgggagcuccaucagcuucugcggcgucaacuccgacaccgugggguggagcuggcccgacggcgccgagcucccguucacgaucgacaaguga

SEQ ID NO: 22996 - RNA, 1410 nt, Artificial Sequence; identical to SEQ ID NO: 22659
  derived and/or modified CDS sequence (AUadapt) from InfluenzaA__AEB21360__NA

SEQ ID NO: 22997 - RNA, 1410 nt, Artificial Sequence; identical to SEQ ID NO: 20007
  derived and/or modified CDS sequence (AUadapt) from InfluenzaA__AEB40209__NA

SEQ ID NO: 22998 - RNA, 1410 nt, Artificial Sequence; identical to SEQ ID NO: 19001
  derived and/or modified CDS sequence (AUadapt) from InfluenzaA__AEB66898__NA

SEQ ID NO: 22999 - RNA, 1413 nt, Artificial Sequence
  derived and/or modified CDS sequence (AUadapt) from InfluenzaA__AEB71103__NA
augaaucccaaccagaagaucaucaccaucggcucggugucccuggggcucgucguguucaacgugcugcugcacgucgugagcaucaucgugaccgucguggugcucggcaacgacgggggcaacgggaucugcaacggcacggucgugaaggaguacaacgagaccgugcgcaucgagcgggucauccaguggcacaacaccuccgugguggaguacaucccguaccugaacggcgggaccuacacgaacaacaccgagagcgucugcgacgugaagggcuucgcccccuucuccaaggacaacggggugcgcaucggcagccgggggcacgucuucgugauccgcgagcccuucguguccugcagcccccgggagugccgcaccuucuuccugacccagggcucccuccugaacgacaagcacucgaacggcacggucaaggaucgguccccguucaagacccugaugagcguggagguggggcagucccccaacgucuaccaggcccgcuucgaggcgguggccuggagcgccaccgccugccacgacggcaagaaguggaugaccaucggggucacgggccccgacuccaaggccguggcggugguccacuacggcggggugcccaccgacaucaucaacagcugggccggcgacauccuccggacccaggaguccagcugcacgugcauccagggggacugcuacugggugaugaccgacggcccggccaaccgccaggcccaguaccggaucuacaaguccaaccaggggaagaucaucggccagauggacaucaacuucaacggcgggcacaucgaggagugcucgugcuaccccaacgacggcaaggucgagugcgugugccgcgacaacuggaccgggaccaaucggcccgugcuggucaucagccccgaccuguccuacaaggugggcuaccucugcgcggggcugccgagcgacacgccccgcggcgaggacgcccaguucuccggcagcugcaccucccccgucgggggccagggguacggcgugaagggguucggcuuccggcagggcaacgacguguggauggggcgcaccaucagccggaccucccgcucgggcuucgaggugauccgggucaagaacggguggacccagacguccaaggagcagauccgcaagcaggucgugguggacaaccugaacuggagcggcuacuccggcagcuucacccuccccaucgagcuguccggcaagagcugccuggugccgugcuucuggguggagaccauccgggggaagcccgaggagaagaccaucuggacguccagcuccagcaucgucaugugcgggguggacuacgagguggccgacugguccuggcacgacggcgccauccuccccuucgacaucgacaagauguga

SEQ ID NO: 23000 - RNA, 1413 nt, Artificial Sequence; identical to SEQ ID NO: 21332
  derived and/or modified CDS sequence (AUadapt) from InfluenzaA__AEB71899__NA

SEQ ID NO: 23001 - RNA, 1410 nt, Artificial Sequence
  derived and/or modified CDS sequence (AUadapt) from InfluenzaA__AEB71910__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacguacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23002 - RNA, 1410 nt, Artificial Sequence; identical to SEQ ID NO: 16318
  derived and/or modified CDS sequence (AUadapt) from InfluenzaA__AEB71919__NA

SEQ ID NO: 23003 - RNA, 1410 nt, Artificial Sequence; identical to SEQ ID NO: 20886
  derived and/or modified CDS sequence (AUadapt) from InfluenzaA__AEB71928__NA

SEQ ID NO: 23004 - RNA, 1410 nt, Artificial Sequence
  derived and/or modified CDS sequence (AUadapt) from InfluenzaA__AEB71939__NA
augaaccccaaccagaagaucaucaccaucggcucggugucccugaccaucagcgccaucugcuucuucaugcagaucgccauccucaucacgaccgucacccugcacuucaagcaguacgaguucaacuccccgcccaacaaccaggugaugcugugcgagcccaccaucaucgagcgcaacaucacggagaucguguaccucaccaacaccaccaucgagaaggagaucugccccaagcuggcggaguaccggaacuggucgaagccgcagugcgacaucacgggguucgcccccuucuccaaggacaacagcauccgccuguccgccggcggggacaucugggucacccgggagcccuacgugucgugcgaccccgacaagugcuaccaguucgcccucggccaggggaccacccugaacaacgugcacuccaacaacacgguccgcgaccggaccccguaccgcacccugcucaugaacgagcugggcgugcccuuccaccugggcaccaagcaggucugcaucgccuggagcuccucguccugccacgacgggaaggcguggcuccacgugugcaucacgggcgacgacaagaacgccaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggcggacaccaagauccucuucaucgaggagggcaagaucgugcacaccagcacgcuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 23005 - RNA, 1410 nt, Artificial Sequence
  derived and/or modified CDS sequence (AUadapt) from InfluenzaA__AEB71950__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggggaccacggcgucaaggggugggccuucgacgacggcaacgacguguggauggggcgcaccaucucggagaagucccggcugggcuacgagaccuucaaggucaucgagggcuggagcaaccacaaguccaagcugcagaucaaccgccaggugaucguggaccgggggaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcaccuccggcacguacgggaccggcagcuggcccgacggggccgaccugaaccucaugccgaucuga

SEQ ID NO: 23006 - RNA, 1413 nt, Artificial Sequence; identical to SEQ ID NO: 22339
  derived and/or modified CDS sequence (AUadapt) from InfluenzaA__AEB71961__NA

SEQ ID NO: 23007 - RNA, 1410 nt, Artificial Sequence
  derived and/or modified CDS sequence (AUadapt) from InfluenzaA__AEB71972__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgucaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugagcugguccaaggagauccugcgcacccaggagucggagugcgugugcaucaacggcacgugcaccgucgugaugaccgacggguccgccagcggcaaggccgacaccaagauccucuucaucgaggagggcaagaucgugcacacgucgacccuguccgggagcgcgcagcacgucgaggagugcuccugcuacccccgguaccccggcgugcgcugcgugugccgggacaacuggaaggggucgaaccgcccgaucgucgacaucaacaucaaggaccacuccaucgugagcuccuacgugugcucgggccuggucggcgacacgccccggaagaacgacuccagcuccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 23008 - RNA, 1410 nt, Artificial Sequence
  derived and/or modified CDS sequence (AUadapt) from InfluenzaA__AEB71983__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaugaaggaccacuccaucgucucguccuacgugugcagcggccuggugggcgacacgccccggcgcaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccccaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23009 - RNA, 1413 nt, Artificial Sequence
  derived and/or modified CDS sequence (AUadapt) from InfluenzaA__AEB71995__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacaucaacaucaacaacacgaacgucguggcgggggaggacaagaccagcgugacccuggccggcaacuccucgcugugcuccaucagcggcugggccaucuacaccaaggacaacuccauccggaucgggagcaagggcgacgucuucgugauccgcgagccguucaucuccugcucgcaccucgagugccggacguucuuccugacccagggggcccugcucaacgacaagcacuccaacggcaccgugaaggaccgcagccccuaccgggcccugauguccugcccccugggggaggcgcccagcccguacaacucgaaguucgaguccgucgccuggagcgccuccgccugccacgacggcaugggcuggcucaccaucgggaucagcggccccgacaacggggcgguggccgugcugaaguacaacggcaucaucacgggcaccaucaaguccuggaagaagcagauccugcgcacccaggagucggagugcgucugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgugaugugcgucugccgggacaacuggcacgggucgaaccgccccuggguguccuucaaccagaaccuggacuaccagaucggcuacaucugcagcggcguguucggggacaacccccggcccgaggacggcgagggguccugcaacccggucaccgugaacggcgcggacggggugaagggcuucagcuacaaguacggcaacggggucuggaucggccgcacgaaguccaaccggcugcgcaagggguucgagaugaucugggaccccaacggcuggaccaacaccgacucggacuucuccgugaagcaggacguggucgccaucaccgacuggagcggguacagcggcuccuucgugcagcaccccgagcucacgggccuggagugcauccggcccugcuucuggguggagcugguccgcgggcucccgcgggagaacaccaccaucuggaccucgggcuccagcaucuccuucugcggggugaacagcgacacggccaacugguccuggcccgacggcgccgagcugcccuucaccaucgacaaguga

SEQ ID NO: 23010 - RNA, 1413 nt, Artificial Sequence; identical to SEQ ID NO: 22607
  derived and/or modified CDS sequence (AUadapt) from InfluenzaA__AEC13316__NA

SEQ ID NO: 23011 - RNA, 1410 nt, Artificial Sequence; identical to SEQ ID NO: 16318
  derived and/or modified CDS sequence (AUadapt) from InfluenzaA__AEC53262__NA

SEQ ID NO: 23012 - RNA, 1410 nt, Artificial Sequence; identical to SEQ ID NO: 16318
  derived and/or modified CDS sequence (AUadapt) from InfluenzaA__AEC53272__NA

SEQ ID NO: 23013 - RNA, 1410 nt, Artificial Sequence; identical to SEQ ID NO: 16318
  derived and/or modified CDS sequence (AUadapt) from InfluenzaA__AEC53282__NA

SEQ ID NO: 23014 - RNA, 1410 nt, Artificial Sequence; identical to SEQ ID NO: 16318
  derived and/or modified CDS sequence (AUadapt) from InfluenzaA__AEC53292__NA

SEQ ID NO: 23015 - RNA, 1410 nt, Artificial Sequence
  derived and/or modified CDS sequence (AUadapt) from InfluenzaA__AEC53302__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaucaucaagagcuggcgcaacaacauccugcggacccaggaguccgagugcgcgugcgugaacgggagcugcuucacggugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugaccggccuggacugcauccgccccugcuucugggucgagcucauccggggccgccccaaggagaacacgaucuggaccagcggguccagcaucuccuucugcggcgugaacagcgacaccgucgggugguccuggcccgacggcgccgagcugccguucaccaucgacaaguga

SEQ ID NO: 23016 - RNA, 1410 nt, Artificial Sequence; identical to SEQ ID NO: 16318
  derived and/or modified CDS sequence (AUadapt) from InfluenzaA__AEC53350__NA

SEQ ID NO: 23017 - RNA, 1410 nt, Artificial Sequence; identical to SEQ ID NO: 19848
  derived and/or modified CDS sequence (AUadapt) from InfluenzaA__AEC53407__NA

SEQ ID NO: 23018 - RNA, 1410 nt, Artificial Sequence; identical to SEQ ID NO: 16318
  derived and/or modified CDS sequence (AUadapt) from InfluenzaA__AEC53427__NA

SEQ ID NO: 23019 - RNA, 1410 nt, Artificial Sequence; identical to SEQ ID NO: 19966
  derived and/or modified CDS sequence (AUadapt) from InfluenzaA__AED99967__NA

SEQ ID NO: 23020 - RNA, 1410 nt, Artificial Sequence; identical to SEQ ID NO: 16274
  derived and/or modified CDS sequence (AUadapt) from InfluenzaA__AEE27161__NA

SEQ ID NO: 23021 - RNA, 1410 nt, Artificial Sequence; identical to SEQ ID NO: 16318
  derived and/or modified CDS sequence (AUadapt) from InfluenzaA__AEE27170__NA

SEQ ID NO: 23022 - RNA, 1410 nt, Artificial Sequence; identical to SEQ ID NO: 16274
  derived and/or modified CDS sequence (AUadapt) from InfluenzaA__AEE27180__NA

SEQ ID NO: 23023 - RNA, 1410 nt, Artificial Sequence
  derived and/or modified CDS sequence (AUadapt) from InfluenzaA__AEE27190__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcgugaucaccgacaccaucaagagcuggcgcaacaacauccugcggacgcaggaguccgagugcgcgugcgucaacgggucgugcuucaccgugaugaccgacggcccguccaacggccaggccagcuacaagaucuucaagaucgagaaggggaagaucgugaaguccgucgagaugaacgcccccaacuaccacuacgaggagugcagcugcuaccccgacuccagcgagaucacgugcgugugccgcgacaacuggcacggcuccaaccggcccugggugucguucaaccagaaccucgaguaccagaucggguacaucugcuccggcaucuucggggacaacccgcgccccaacgacaagaccggcagcugcggccccgucuccagcaacggggccaacggcgugaagggguucuccuucaaguacggcaacgggguguggaucggccggaccaagagcaucagcucccgcaacggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccguggggugguccuggcccgacggcgccgagcugccguucacgaucgacaaguga

SEQ ID NO: 23024 - RNA, 1410 nt, Artificial Sequence; identical to SEQ ID NO: 20363
  derived and/or modified CDS sequence (AUadapt) from InfluenzaA__AEE27200__NA

SEQ ID NO: 23025 - RNA, 1410 nt, Artificial Sequence; identical to SEQ ID NO: 22199
  derived and/or modified CDS sequence (AUadapt) from InfluenzaA__AEG64755__NA

SEQ ID NO: 23026 - RNA, 1362 nt, Artificial Sequence
  derived and/or modified CDS sequence (AUadapt) from InfluenzaA__AEG64765__NA
augaaucccaaccagaagaucaucaccaucggcucgaucugcaugguggucgggaucaucucccugauccuccagaucggcaacaucaucagcaucuggaucucccacagcauccagaccgggaaucagaaccacacgggcaucugcaaccaggggaucaucaccuacaacgugguggccggccaggacuccaccagcgucauccugaccggcaauuccagccugugcccgauccgcgggugggccauccacuccaaggacaacggcauccggaucgggagcaagggcgacguguucgugauccgcgagcccuuuaucuccugcagccaccucgagugccggacguucuuccugacccagggggcgcugcucaacgacaagcauuccaacggcaccgucaaggaccgcagccccuaccgggcccugauguccugccccgugggcgaggccccgucgcccuacaacucccgcuuugagagcguggccugguccgccagcgcgugccacgacgggaugggcuggcugaccaucgggaucagcggccccgacaacggcgccgucgccgugcucaaguauaacgggaucaucacggagaccaucaaguccuggcggaagaagauccugcgcacccaggagagcgagugcacgugcgugaacggcuccugcuucaccaucaugaccgacgggcccagugacggccuggccuccuacaagaucuucaagaucgagaaggggaaggucaccaagagcaucgagcucaacgcgccgaacucccacuacgaggaguguagcugcuaccccgacaccggcaaggugaugugcgugugccgggacaacuggcauggcuccaaccgccccugggucagcuucgaccagaaccuggacuaccagaucggguacaucuguuccggcguguucggggacaacccccggccgaaggacggcacggggucgugcggccccguguccgccgacggcgccaacggggucaagggcuuuagcuaccgcuacgggaacggcguguggaucgggcggaccaaguccgacagcucccgccacggcuucgagaugaucugggaucccaacggcuggaccgagaccgacagccgguucuccgugcgccaggacgucguggccaugacggaccggagcggguacaguggcuccuucgugcagcaccccgagcugaccgggcucgacugcaugcgcccgugcuucugggucgagcugauccggggccgccccgaggagaagaccaucuggaccagcggcuccaucaucagcuuuugcggggugaacuccgacacggucgacuggagcuggcccgacggcgccgagcugcccuucaccaucgacaaguga

SEQ ID NO: 23027 - RNA, 1410 nt, Artificial Sequence
  derived and/or modified CDS sequence (AUadapt) from InfluenzaA__AEG64787__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaaccggcugcgcacgcaggaguccgagugcgcgugcgugaacgggagcugcuucaccgugaugaccgacggcccguccgacggccaggccagcuacaagaucuuccggaucgagaaggggaagaucgucaaguccguggagaugaacgcccccaacuaccacuacgaggagugcucgugcuaccccgacuccagcgagaucacgugcgugugccgcgacaacuggcacggcuccaaccggcccugggucagcuucaaccagaaccucgaguaccagaucggguacaucugcuccggcaucuucggggacaacccgcgccccaacgacaagaccggcagcugcggccccguguccucgaacggggccaacggcgugaagggguucuccuucaaguacggcaacggggucuggaucggccggaccaagagcaucagcucccgcaacggcuucgagaugaucugggaccccaacggguggaccggcaccgacaacgacuucagcaucaagcaggacaucguggggaucaacgagugguccggcuacucgggguccuucgugcagcacccggagcugacgggccuggacugcauccggcccugcuucugggucgagcucauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 23028 - RNA, 1410 nt, Artificial Sequence
  derived and/or modified CDS sequence (AUadapt) from InfluenzaA__AEG64837__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucgcugaucuacaacgggcggcugguggacuccguggucagcugguccaaggagauccuccgcacccaggagucggagugcgugugcaucaacggcacgugcaccguggucaugaccgacggguccgccagcggcaaggccgacaccaagauccuguucaucgaggagggcaagaucgugcacacgucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccucgugggcgacacgccccggaagaacgacuccucguccagcucccacugccuggaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcuccagaucaaccgccaggugaucguggaccggggcaaccgcuccggguacucgggcaucuucuccgucgagggcaagagcugcaucaaccggugcuucuacguggagcugauccgcgggcggaaggaggagaccgaggugcuguggaccucgaacuccaucgucguguucugcggcacgagcgggaccuacggcaccggguccuggccggacggcgccgaccucaaccugaugcccaucuga

SEQ ID NO: 23029 - RNA, 1410 nt, Artificial Sequence
  derived and/or modified CDS sequence (AUadapt) from InfluenzaA__AEG64848__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggcugaagccgcagugcgacaucaccggguucgcgcccuucucgaaggacaacuccauccgccucagcgccggcggggacaucugggucacccgggagcccuacguguccugcgaccccgacaagugcuaccaguucgcccugggccaggggaccacgcugaacaacgugcacucgaacaacaccguccgcgaccggaccccguaccgcacccuccugaugaacgagcugggcgugcccuuccaccucggcacgaagcaggucugcaucgccugguccagcuccucgugccacgacgggaaggccuggcugcacgugugcaucaccggcgacgacaagaacgcgaccgccuccuucaucuacaacgggcggcugguggacagcguggucuccuggucgaaggagauccuccgcacccaggaguccgagugcgugugcaucaacggcacgugcaccguggucaugaccgacgggagcgccuccggcaaggccgacaccaagauccuguucaucgaggagggcaagaucgugcacacgucgacccugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccucgugggcgacacgccccggaagaacgacucguccagcuccucgcacugccuggaccccaacaacgaggagggcgggcacggggucaagggcugggccuucgacgacgggaacgacguguggaugggccgcaccaucaacgagaccucccggcugggcuacgagaccuucaaggucaucgagggguggagcaaccccaaguccaagcuccagaucaacaagcaggucaucguggaccgcggcaaccggucgggguacuccggcaucuucagcguggaggggaaguccugcaucaaccgcugcuucuacguggagcugauccggggccgcaaggaggagaccgaggugcuguggaccucgaacagcaucgucguguucugcggcacguccgggaccuacggcaccgggagcuggccggacggcgccgaccucaaccugaugcccaucuga

SEQ ID NO: 23030 - RNA, 1410 nt, Artificial Sequence; identical to SEQ ID NO: 16635
  derived and/or modified CDS sequence (AUadapt) from InfluenzaA__AEG64859__NA

SEQ ID NO: 23031 - RNA, 1410 nt, Artificial Sequence; identical to SEQ ID NO: 16463
  derived and/or modified CDS sequence (AUadapt) from InfluenzaA__AEG64870__NA

SEQ ID NO: 23032 - RNA, 1410 nt, Artificial Sequence; identical to SEQ ID NO: 16655
  derived and/or modified CDS sequence (AUadapt) from InfluenzaA__AEG64881__NA

SEQ ID NO: 23033 - RNA, 1410 nt, Artificial Sequence; identical to SEQ ID NO: 16463
  derived and/or modified CDS sequence (AUadapt) from InfluenzaA__AEG64892__NA

SEQ ID NO: 23034 - RNA, 1410 nt, Artificial Sequence; identical to SEQ ID NO: 16539
  derived and/or modified CDS sequence (AUadapt) from InfluenzaA__AEG64914__NA

SEQ ID NO: 23035 - RNA, 1410 nt, Artificial Sequence; identical to SEQ ID NO: 16539
  derived and/or modified CDS sequence (AUadapt) from InfluenzaA__AEG64925__NA

SEQ ID NO: 23036 - RNA, 1410 nt, Artificial Sequence
  derived and/or modified CDS sequence (AUadapt) from InfluenzaA__AEG64936__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggaggacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacagcuccucguccucgcacugccuggaccccaacaacgaggagggcgggcacggggucaagggcugggccuucgacgacggcaacgacguguggauggggcgcaccaucuccgagaagcugcggagcggcuacgagaccuucaaggucaucgaggggugguccaagcccaacucgaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccucgaacuccaucgucguguucugcggcaccagcgggaccuacggcacgggguccuggccggacggcgccgacaucaaccugaugcccaucuga

SEQ ID NO: 23037 - RNA, 1410 nt, Artificial Sequence; identical to SEQ ID NO: 16552
  derived and/or modified CDS sequence (AUadapt) from InfluenzaA__AEG64947__NA

SEQ ID NO: 23038 - RNA, 1410 nt, Artificial Sequence; identical to SEQ ID NO: 16539
  derived and/or modified CDS sequence (AUadapt) from InfluenzaA__AEG64958__NA

SEQ ID NO: 23039 - RNA, 1410 nt, Artificial Sequence; identical to SEQ ID NO: 16539
  derived and/or modified CDS sequence (AUadapt) from InfluenzaA__AEG64969__NA

SEQ ID NO: 23040 - RNA, 1410 nt, Artificial Sequence; identical to SEQ ID NO: 16539
  derived and/or modified CDS sequence (AUadapt) from InfluenzaA__AEG64980__NA

SEQ ID NO: 23041 - RNA, 1410 nt, Artificial Sequence
  derived and/or modified CDS sequence (AUadapt) from InfluenzaA__AEG64991__NA
augaaccccaaccagaagaucaucaccaucggcucggugucccugaccaucucgacgaucugcuucuucaugcagaucgccauccucaucaccaccgucacccugcacuucaagcaguacgaguccaacagcccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcaacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacgacaccguccacgaccgcaccccguaccggacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcgccugguggacagcaucgucuccuggucgaaggagauccugcggacccaggaguccgagugcgugugcaucaacggcacgugcaccguggucaugaccgacgggagcgccucgggcaaggccgacaccaagauccucuucaucgaggagggcaagaucgugcacacguccacccugagcggguccgcgcagcacguggaggagugcucgugcuacccccgcuaccccggcguccggugcgugugccgcgacaacuggaagggguccaaccggccgaucguggacaucaacaucaaggacuacagcaucgucuccucguacgugugcuccggccuggugggcgacacgccccgcaagaacgacagcuccucguccagccacugccucgaccccaacaacgaggagggcgggcacggggucaagggcugggccuucgacgacgggaacgacguguggaugggccggaccaucuccgagaagcugcgcucgggcuacgagaccuucaaggucaucgaggggugguccaaccccaacagcaagcugcagaccaaccgccaggugaucguggaccggggcaaccgguccggguacucgggcaucuucagcgucgaggggaaguccugcaucaaccgcugcuucuacguggagcucauccggggccgcaaggaggagaccgaggugcuguggaccucgaacuccaucgucguguucugcggcacgagcgggaccuacggcaccggguccuggccggacggcgccgacaucaaccugaugcccaucuga

SEQ ID NO: 23042 - RNA, 1410 nt, Artificial Sequence; identical to SEQ ID NO: 16729
  derived and/or modified CDS sequence (AUadapt) from InfluenzaA__AEG65002__NA

SEQ ID NO: 23043 - RNA, 1410 nt, Artificial Sequence
  derived and/or modified CDS sequence (AUadapt) from InfluenzaA__AEG65013__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggacauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucgucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaccaaccgccaggugaucguggagcggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcacgagcgggaccuacggcaccggguccuggccggacggcgccgacaucaaccucaugcccaucuga

SEQ ID NO: 23044 - RNA, 1410 nt, Artificial Sequence
  derived and/or modified CDS sequence (AUadapt) from InfluenzaA__AEG65024__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccacgugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucagcgagaagcugcgccugggcuacgagaccuucaaggucaucgaggggugguccaaccccaacucgaagcuccagaucaaccgccaggugaucguggaccggggcaaccgguccggguacagcggcaucuucuccgucgagggcaagucgugcaucaaccgcugcuucuacguggagcugauccgggggcgcaaggaggagaccgaggugcuguggaccagcaacuccaucgucguguucugcggcaccagcgggacguacggcaccggguccuggccggacggcgccgacaucaaccucaugcccaucuga

SEQ ID NO: 23045 - RNA, 1410 nt, Artificial Sequence
  derived and/or modified CDS sequence (AUadapt) from InfluenzaA__AEG65035__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggaggucugccccaagcuggccgaguaccggaacuggucgaagccgcagugcaacaucaccggguucgcgcccuucuccaaggacaacagcauccgccuguccgccggcggggacaucugggugacccgggagcccuacgugagcugcgaccucgacaagugcuaccaguucgcccugggccaggggaccacgcugaacaacguccacuccaacgacaccgugcacgaccgcacccccuaccggacccuccugaugaacgagcugggcgugccguuccaccucggcacgaagcaggucugcaucgccuggucguccagcuccugccacgacgggaaggccuggcugcacgugugcgugaccggcgacgacaagaacgcgaccgccucguucaucuacaacgggcgccuggucgacuccaucgugagcugguccaaggagauccuccggacccaggagagcgagugcgugugcaucaacggcacgugcaccgucgugaugaccgacggguccgccucgggcaaggccgacaccaagauccuguucaucgaggagggcaagaucgugcacacgagcacccuguccgggucggcgcagcacgucgaggagugcuccugcuacccccgcuaccccggcgugcggugcgugugccgcgacaacuggaaggggagcaaccggcccaucgucgacaucaacaucaaggacuacuccaucgugagcuccuacgugugcucgggccucgucggcgacaccccgcgcaagaacgacuccagcuccucgucccacugccuggaccccaacaacgaggagggcgggcacggggugaagggcugggccuucgacgacgggaacgacgucuggaugggccggaccaucagcgagaagcugcgcuccggcuacgagacguucaaggugaucgagggguggagcaaccccaacuccaagcuccagaucaaccgccaggugaucgucgaccggggcaaccggucgggguacuccggcaucuucagcguggagggcaagucgugcaucaaccgcugcuucuacguggagcugauccgggggcgcaaggaggagaacgagguccuguggaccuccaacagcaucgugguguucugcggcaccuccgggaccuacggcacggggagcuggcccgacggcgccgacaucaaccucaugccgaucuga

SEQ ID NO: 23046 - RNA, 1410 nt, Artificial Sequence; identical to SEQ ID NO: 17114
  derived and/or modified CDS sequence (AUadapt) from InfluenzaA__AEG65057__NA

SEQ ID NO: 23047 - RNA, 1410 nt, Artificial Sequence; identical to SEQ ID NO: 18109
  derived and/or modified CDS sequence (AUadapt) from InfluenzaA__AEG65068__NA

SEQ ID NO: 23048 - RNA, 1410 nt, Artificial Sequence
  derived and/or modified CDS sequence (AUadapt) from InfluenzaA__AEG65079__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgaagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccucggggcacugccucgaccccaacaacgaggagggcgggcacggcgucaaggggugggccuucgacgacggcaacgacguguggaugggccggaccaucuccgagaagcugcgcagcggguacgagaccuucaaggucaucgagggcugguccaaccccaacucgaagcugcagaucaaccgccaggugaucguggaccgggggaaccgguccggcuacagcgggaucuucuccgucgagggcaagucgugcaucaaccgcugcuucuacguggagcucauccggggccgcaaggaggagaccgaggugcuguggaccagcaacuccaucgucguguucugcgggaccagcggcacguacgggaccggcuccuggccggacggggccgacaucaaccugaugcccaucuga

SEQ ID NO: 23049 - RNA, 1410 nt, Artificial Sequence
  derived and/or modified CDS sequence (AUadapt) from InfluenzaA__AEG65090__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucauccacacgagcacccuguccgggucggcgcagcacguggaggagugcuccugcuacccccgcuaccccggcgugcggugcgucugccgcgacaacuggaaggggagcaaccggccgaucguggacaucaacaucaaggacuacuccaucgugagcuccuacgucugcucgggccuggugggcgacacgccccgcaagaacgacuccagcuccucgucccacugccucgaccccaacaacgaggagggcgggcacggggugaagggcugggccuucgacgacgggaacgacgucuggaugggccggaccaucagcgagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucucccugaugcccaucuga

SEQ ID NO: 23050 - RNA, 1410 nt, Artificial Sequence
  derived and/or modified CDS sequence (AUadapt) from InfluenzaA__AEG65101__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccgacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccagcuccugccacgacgggaaggccuggcuccacgugugcgugaccggcgacgacaagaacgcgaccgccucguucaucuacaacgggcgccugguggacuccgucgugagcugguccaaggacauccugcggacccaggagucggagugcgugugcaucaacggcacgugcaccgucgugaugaccgacggguccgccagcggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaagaacuacuccaucgugucguccuacgugugcagcggccuggucggcgacacgccccgcaagaccgacuccucguccagcucccacugccucgaccccaacaacgaggagggcgggcacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaccgagguccuguggaccagcaacuccaucgugguguucugcggcacgagcgggaccuacggcaccggguccuggccggacggcgccgacaucaaccucaugcccaucuga

SEQ ID NO: 23051 - RNA, 1410 nt, Artificial Sequence
  derived and/or modified CDS sequence (AUadapt) from InfluenzaA__AEG65123__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaccaucgagcgcaacaucaccgagaucguguaccucaccaacacgaccaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccgucgugucgugguccaaggacauccugcggacgcaggagagcgagugcgugugcaucaacgggaccugcaccgucgugaugaccgacggguccgccucgggcaaggccgacacgaagauccucuucaucgaggagggcaagaucgugcacaccagcacccuguccgggagcgcgcagcacgucgaggagugcuccugcuacccccgcuaccccggcgugcggugcgugugccgcgacaacuggaaggggucgaaccggccgaucgucgacaucaacaucaagaacuacuccaucgugagcuccuacgugugcucgggccuggucggcgacacgccccgcaagaccgacuccagcuccucgucccacugccucgaccccaacaacgaggagggcggccacggggugaagggcugggccuucgacgacgggaacgacgucuggaugggccggaccaucagcgagaagcugcgccugggcuacgagaccuucaaggugaucgaggggugguccaaccccaacucgaagcuccagaucaaccgccaggugaucgucgaccggggcaaccgguccggguacagcggcaucuucuccguggagggcaagucgugcaucaaccgcugcuucuacguggagcugauccgggggcgcaaggaggagaacgagguccuguggaccagcaacuccaucgugguguucugcggcacgagcgggaccuacggcaccggguccuggccggacggcgccgacaucaaccucaugcccaucuga

SEQ ID NO: 23052 - RNA, 1410 nt, Artificial Sequence; identical to SEQ ID NO: 18109
  derived and/or modified CDS sequence (AUadapt) from InfluenzaA__AEG65134__NA

SEQ ID NO: 23053 - RNA, 1410 nt, Artificial Sequence
  derived and/or modified CDS sequence (AUadapt) from InfluenzaA__AEG65145__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacagcaucgucuccucguacgugugcuccgggcucgugggcgacacgccccggaagaacgacucguucuccaacagccacugccuggaccccaacaacgaggagggcgggcacggggucaagggcugggccuucgacgacggcaacgacguguggauggggcgcaccaucuccgagaagcugcggucgggcuacgagaccuucaaggucaucgaggggugguccaagcccaacagcaagcuccagaucaaccgccaggugaucguggagcggggcaaccgcuccggguacucgggcaucuucuccgucgagggcaagagcugcaucaaccggugcuucuacguggagcugauccgcgggcggaaggaggagaccgaggugugguggaccuccaacucgaucgucguguucugcggcaccagcgggaccuacggcacgggguccuggccggacggcgccgacaucaaccugaugcccaucuga

SEQ ID NO: 23054 - RNA, 1410 nt, Artificial Sequence
  derived and/or modified CDS sequence (AUadapt) from InfluenzaA__AEG65156__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacgagaacgccaccgccuccuucaucuacaacggccggcugguggacagcaucggguccuggucgaagaagauccuccgcacccaggaguccgagugcgucugcaucaacggcacgugcaccguggugaugaccgacggcagcgccuccgggaaggcggacaccaagauccuguucaucgaggagggcaagaucguccacacgucgacccugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggacguacggcaccgggagcuggccggacggcgccgacaucaaccugaugcccaucuga

SEQ ID NO: 23055 - RNA, 1410 nt, Artificial Sequence
  derived and/or modified CDS sequence (AUadapt) from InfluenzaA__AEG65167__NA
augaaccccaaccagaagaucaucaccaucggcucggugucccugaccaucgccacgaucugcuuccucaugcagaucgccauccuggucaccaccgugacccugcacuucaagcaguacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacgacaccguccacgaccgcaccccguaccggacccuccugaugaacgagcugggcgugcccuuccaccucgggacgcgccaggugugcaucgccugguccucguccagcugccacgacggcaaggcguggcugcacgucugcgugaccggggacgacgagaacgccaccgccuccuucaucuacaacggccggcugguggacucgaucggguccuggagcaagaagauccuccgcacccaggaguccgagugcgucugcaucaacggcacgugcaccguggugaugaccgacggcucggccuccgggaaggcggacaccaagauccuguucaucgaggagggcaagaucguccacaucagcacgcugucgggguccgcccggcacguggaggagugcucgugcuacccccgcuaccccggcgugcggugcgucugccgcgacaacuggaagggcuccaaccggccgaucguggacaucaacgugaaggacuacagcaucgucuccucguacgugugcuccgggcucgugggcgacacgccccgcaagaacgacagcuucuccucgucccacugccuggaccccaacaacgaggagggcgggcacggggucaagggcugggccuucgacgacggcaacgacguguggauggggcggaccaucagcgagaagcugcgcuccggcuacgagaccuucaaggucaucgagggguggucgaagcccaacuccaagcuccagaucaaccgccaggugaucguggagcggggcaaccggagcggguacuccggcaucuucucggucgagggcaaguccugcaucaaccgcugcuucuacguggagcugauccgggggcgcaaggaggagaccgaggugugguggaccagcaacucgaucgucguguucugcggcaccuccgggaccuacggcacggggagcuggccggacggcgccgacaucaaccugaugcccaucuga

SEQ ID NO: 23056 - RNA, 1410 nt, Artificial Sequence
  derived and/or modified CDS sequence (AUadapt) from InfluenzaA__AEG65178__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacagcaacaacaccguccacgaccgcaccccguaccggacccuccugaugaacgagcugggcgugcccuuccaccucgggacgcgccaggugugcaucgccugguccucguccucgugccacgacggcaaggcguggcugcacgucugcgugaccggggacgacaagaacgccaccgccuccuucaucuacaacggccggcugguggacagcaucggguccuggucgaagaacauccuccgcacccaggaguccgagugcgucugcaucaacggcacgugcaccguggugaugaccgacggcagcgccuccgggaaggcggacaccaagauccuguucaucgaggagggcaagaucguccacaucucgacgcugagcggguccgcccagcacguggaggagugcucgugcuacccccgguaccccggcgugcgcugcgucugccgggacaacuggaagggcuccaaccgcccgaucguggacaucaacgugaaggacuacucgaucgucuccagcuacgugugcuccgggcucgugggcgacacgccccggaagaacgacucguucuccagcucccacugccuggaccccaacaacgaggagggcgggcacggggucaagggcugggccuucgacgacggcaacgacguguggauggggcgcaccaucucggagaagcugcgguccggcuacgagaccuucaaggucaucgagggguggucgaagcccaacuccaagcuccagaucaaccgccaggugaucguggagcggggcaaccgcagcggguacuccggcaucuucucggucgagggcaaguccugcaucaaccggugcuucuacguggagcugauccgcgggcggaaggaggagaccgaggugugguggaccagcaacucgaucgucguguucugcggcaccuccgggaccuacggcacggggagcuggccggacggcgccgacaucaaccugaugcccaucuga

SEQ ID NO: 23057 - RNA, 1410 nt, Artificial Sequence
  derived and/or modified CDS sequence (AUadapt) from InfluenzaA__AEG65189__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaacgacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23058 - RNA, 1410 nt, Artificial Sequence
  derived and/or modified CDS sequence (AUadapt) from InfluenzaA__AEG65200__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaaggaggugcugcggacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgcuaccccggcgugcggugcgugugccgcgacaacuggaaggggagcaaccggccgaucgucgacaucaacaucaaggacuacuccaucgugucguccuacgugugcagcggccuggucggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaccaaccgccaggugaucgucgaccggggcaaccggucgggguacuccggcaucuucagcguggagggcaagucgugcaucaaccgcugcuucuacguggagcucauccgggggcgcaaggaggagaccgagguccuguggaccuccaacagcaucgugguguucugcggcacguccgggaccuacggcaccgggagcuggccggacggcgccgacaucaaccugaugcccaucuga

SEQ ID NO: 23059 - RNA, 1410 nt, Artificial Sequence; identical to SEQ ID NO: 17114
  derived and/or modified CDS sequence (AUadapt) from InfluenzaA__AEG65211__NA

SEQ ID NO: 23060 - RNA, 1410 nt, Artificial Sequence; identical to SEQ ID NO: 17116
  derived and/or modified CDS sequence (AUadapt) from InfluenzaA__AEG65222__NA

SEQ ID NO: 23061 - RNA, 1410 nt, Artificial Sequence
  derived and/or modified CDS sequence (AUadapt) from InfluenzaA__AEG65233__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucaucgacaucaacaucaaggacuacuccaucgugagcuccuacgucugcucgggccuggugggcgacacgccccgcaagaacgacuccagcuccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 23062 - RNA, 1410 nt, Artificial Sequence
  derived and/or modified CDS sequence (AUadapt) from InfluenzaA__AEG65244__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgcagcaggucugcaucgccuggagcuccucguccugccacgacgggaaggccuggcuccacgugugcgugaccggcgacgacgagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgccucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaccaggagaccgaggugcuguggaccuccaacagcaucguggucuucugcggcaccuccgggacguacggcaccgggagcuggccggacggcgccgacaucaaccugaugcccaucuga

SEQ ID NO: 23063 - RNA, 1410 nt, Artificial Sequence; identical to SEQ ID NO: 17116
  derived and/or modified CDS sequence (AUadapt) from InfluenzaA__AEG65255__NA

SEQ ID NO: 23064 - RNA, 1410 nt, Artificial Sequence; identical to SEQ ID NO: 16993
  derived and/or modified CDS sequence (AUadapt) from InfluenzaA__AEG65266__NA

SEQ ID NO: 23065 - RNA, 1410 nt, Artificial Sequence; identical to SEQ ID NO: 16993
  derived and/or modified CDS sequence (AUadapt) from InfluenzaA__AEG65277__NA

SEQ ID NO: 23066 - RNA, 1410 nt, Artificial Sequence
  derived and/or modified CDS sequence (AUadapt) from InfluenzaA__AEG65288__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcugguggaguaccggaacugguccaagccgcagugcaacaucaccggguucgcgcccuucagcaaggacaacuccauccgccucucggccggcggggacaucugggugacccgggagcccuacgucuccugcgaccccgacaagugcuaccaguucgcccugggccaggggaccacgcugaacaacggccacagcaacgacaccgugcacgaccgcaccccguaccggacccuccugaugaacgagcugggcgugcccuuccaccucgggacgcgccaggucugcaucgccugguccucguccagcugccacgacggcaaggccuggcugcacgugugcgugaccggggacgacaagaacgcgaccgccuccuucaucuacaacggccggcuggucgacucgaucggguccuggagcaagaagauccuccgcacccaggaguccgagugcgugugcaucaacggcacgugcaccguggucaugaccgacggcucggccuccgggaaggccgacaccaagauccuguucaucgaggagggcaagaucgugcacaucagcacgcugucgggguccgcgcagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacaacagcuucuccucgucccacugccuggaccccaacaacgaggagggcgggcacggggugaagggcugggccuucgacgacggcaacgacgucuggauggggcgcaccaucagcgagaagcugcgguccggcuacgagaccuucaaggugaucgagggguggucgaagcccaacuccaagcuccagaucaaccgccaggugaucgucgagcggggcaaccgcagcggguacuccggcaucuucucgguggagggcaaguccugcaucaaccggugcuucuacguggagcugauccgcgggcggaaggaggagaccgaggucugguggaccagcaacucgaucgugguguucugcggcaccuccgggaccuacggcacggggagcuggccggacggcgccgacaucaaccugaugcccaucuga

SEQ ID NO: 23067 - RNA, 1410 nt, Artificial Sequence; identical to SEQ ID NO: 16993
  derived and/or modified CDS sequence (AUadapt) from InfluenzaA__AEG65299__NA

SEQ ID NO: 23068 - RNA, 1410 nt, Artificial Sequence; identical to SEQ ID NO: 17116
  derived and/or modified CDS sequence (AUadapt) from InfluenzaA__AEG65310__NA

SEQ ID NO: 23069 - RNA, 1410 nt, Artificial Sequence; identical to SEQ ID NO: 17116
  derived and/or modified CDS sequence (AUadapt) from InfluenzaA__AEG65321__NA

SEQ ID NO: 23070 - RNA, 1410 nt, Artificial Sequence; identical to SEQ ID NO: 17116
  derived and/or modified CDS sequence (AUadapt) from InfluenzaA__AEG65332__NA

SEQ ID NO: 23071 - RNA, 1410 nt, Artificial Sequence; identical to SEQ ID NO: 17116
  derived and/or modified CDS sequence (AUadapt) from InfluenzaA__AEG65354__NA

SEQ ID NO: 23072 - RNA, 1410 nt, Artificial Sequence; identical to SEQ ID NO: 17116
  derived and/or modified CDS sequence (AUadapt) from InfluenzaA__AEG65365__NA

SEQ ID NO: 23073 - RNA, 1410 nt, Artificial Sequence
  derived and/or modified CDS sequence (AUadapt) from InfluenzaA__AEG65376__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgcagcaggucugcaucgccuggagcuccucguccugccacgacgggaaggccuggcuccacgugugcgugaccggcgacgacgagaacgcgaccgccagcuucaucuacaacgggcgccugguggacuccaucgucagcugguccaagaagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaccaggagaccgaggugcuguggaccuccaacagcaucgucguguucugcggcaccuccgggacguacggcaccgggagcuggccggacggcgccgacaucaaccugaugcccaucuga

SEQ ID NO: 23074 - RNA, 1410 nt, Artificial Sequence; identical to SEQ ID NO: 16993
  derived and/or modified CDS sequence (AUadapt) from InfluenzaA__AEG65387__NA

SEQ ID NO: 23075 - RNA, 1410 nt, Artificial Sequence; identical to SEQ ID NO: 16993
  derived and/or modified CDS sequence (AUadapt) from InfluenzaA__AEG65398__NA

SEQ ID NO: 23076 - RNA, 1410 nt, Artificial Sequence; identical to SEQ ID NO: 16993
  derived and/or modified CDS sequence (AUadapt) from InfluenzaA__AEG65409__NA

SEQ ID NO: 23077 - RNA, 1410 nt, Artificial Sequence; identical to SEQ ID NO: 16993
  derived and/or modified CDS sequence (AUadapt) from InfluenzaA__AEG65420__NA

SEQ ID NO: 23078 - RNA, 1410 nt, Artificial Sequence; identical to SEQ ID NO: 16993
  derived and/or modified CDS sequence (AUadapt) from InfluenzaA__AEG65431__NA

SEQ ID NO: 23079 - RNA, 1410 nt, Artificial Sequence; identical to SEQ ID NO: 17114
  derived and/or modified CDS sequence (AUadapt) from InfluenzaA__AEG65442__NA

SEQ ID NO: 23080 - RNA, 1410 nt, Artificial Sequence; identical to SEQ ID NO: 17116
  derived and/or modified CDS sequence (AUadapt) from InfluenzaA__AEG65453__NA

SEQ ID NO: 23081 - RNA, 1410 nt, Artificial Sequence; identical to SEQ ID NO: 17116
  derived and/or modified CDS sequence (AUadapt) from InfluenzaA__AEG65464__NA

SEQ ID NO: 23082 - RNA, 1410 nt, Artificial Sequence; identical to SEQ ID NO: 17116
  derived and/or modified CDS sequence (AUadapt) from InfluenzaA__AEG65475__NA

SEQ ID NO: 23083 - RNA, 1410 nt, Artificial Sequence
  derived and/or modified CDS sequence (AUadapt) from InfluenzaA__AEG65486__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgagcaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgacaucaaccugaugcccaucuga

SEQ ID NO: 23084 - RNA, 1410 nt, Artificial Sequence; identical to SEQ ID NO: 17116
  derived and/or modified CDS sequence (AUadapt) from InfluenzaA__AEG65497__NA

SEQ ID NO: 23085 - RNA, 1410 nt, Artificial Sequence; identical to SEQ ID NO: 17116
  derived and/or modified CDS sequence (AUadapt) from InfluenzaA__AEG65508__NA

SEQ ID NO: 23086 - RNA, 1410 nt, Artificial Sequence; identical to SEQ ID NO: 17116
  derived and/or modified CDS sequence (AUadapt) from InfluenzaA__AEG65519__NA

SEQ ID NO: 23087 - RNA, 1410 nt, Artificial Sequence; identical to SEQ ID NO: 17116
  derived and/or modified CDS sequence (AUadapt) from InfluenzaA__AEG65530__NA

SEQ ID NO: 23088 - RNA, 1410 nt, Artificial Sequence; identical to SEQ ID NO: 17116
  derived and/or modified CDS sequence (AUadapt) from InfluenzaA__AEG65541__NA

SEQ ID NO: 23089 - RNA, 1410 nt, Artificial Sequence
  derived and/or modified CDS sequence (AUadapt) from InfluenzaA__AEG65563__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgaccgcugcuaccaguucgcccucggccaggggaccacgcugaacaacgugcacuccaacgacaccguccacgaccggaccccguaccgcacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcggcugguggacuccaucgucagcugguccaagaagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggacuacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagcugcgguccggcuacgagaccuucaaggucaucgagggguggagcaaccccaacuccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 23090 - RNA, 1410 nt, Artificial Sequence
  derived and/or modified CDS sequence (AUadapt) from InfluenzaA__AEG65574__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggucgugguccaagccgcagugcgacaucaccggguucgcgcccuucagcaaggacaacuccauccgccugagcgccggcggggacaucugggucacccgggagcccuacguguccugcgaccccgaccgcugcuaccaguucgcccucggccaggggaccacgcugaacaacgugcacucgaacgacaccguccacgaccggaccccguaccgcacccugcucaugaacgagcugggcgugcccuuccaccugggcacgaagcaggucugcaucgccugguccagcuccucgugccacgacgggaaggccuggcuccacgugugcgugaccggcgacgacaagaacgcgaccgccuccuucaucuacaacgggcggcugguggacagcaucgucuccuggagcaagaagauccugcgcacccaggaguccgagugcgugugcaucaacggcacgugcaccguggucaugaccgacgggucggccagcggcaaggccgacaccaagauccucuucaucgaggagggcaagaucgugcacacguccacccugucgggguccgcgcagcacguggaggagugcagcugcuacccccgguaccccggcguccgcugcgugugccgggacaacuggaagggguccaaccgcccgaucguggacaucaacaucaaggacuacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucuccgagaagcugcggagcggcuacgagaccuucaaggucaucgaggggugguccaaccccaacucgaagcugcagaucaaccgccaggugaucguggaccggggcaaccgcuccggguacagcggcaucuucucggucgaggggaaguccugcaucaaccggugcuucuacguggagcucauccgcggccggaaggaggagaccgaggugcuguggaccagcaacuccaucgucguguucugcggcaccagcgggacguacggcaccggguccuggccggacggcgccgacaucaaccugaugcccaucuga

SEQ ID NO: 23091 - RNA, 1410 nt, Artificial Sequence; identical to SEQ ID NO: 23089
  derived and/or modified CDS sequence (AUadapt) from InfluenzaA__AEG65585__NA

SEQ ID NO: 23092 - RNA, 1410 nt, Artificial Sequence; identical to SEQ ID NO: 23089
  derived and/or modified CDS sequence (AUadapt) from InfluenzaA__AEG65596__NA

SEQ ID NO: 23093 - RNA, 1410 nt, Artificial Sequence
  derived and/or modified CDS sequence (AUadapt) from InfluenzaA__AEG65607__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgccucguccuacgucugcagcggccuggugggcgacacgccccgcaagaacgacuccucguccagcucccacugccucgaccccaacaacgaggagggcgggcacggggugaagggcugggccuucgacgacgggaacgacgucuggaugggccggaccaucucggagaagcugcgcuccggcuacgagaccuucaaggugaucgagggguggagcaaccccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcaccuccgggacguacggcaccgggagcuggccggacggcgccgacaucaaccugaugcccaucuga

SEQ ID NO: 23094 - RNA, 1410 nt, Artificial Sequence
  derived and/or modified CDS sequence (AUadapt) from InfluenzaA__AEG65629__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugagcugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggucguccagcuccugccacgacgggaaggccuggcuccacgugugcgugaccggcgacgacaagaacgcgaccgccucguucaucuacaacgggcgccugguggacuccaucgucagcugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggacuacuccaucgucagcuccuacgugugcucgggccuggugggcgacacgccccgcaagaacgacuccagcuccucgucccacugccucgaccccaacgacgaggagggcgggcacggggucaagggcugggccuucgacgacgggaacgacguguggaugggccggaccaucagcgagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaucgaggugcuguggaccuccaacagcaucgucguguucugcggcaccuccgggaccuacggcacggggagcuggccggacggcgccgacaucaaccugaugcccaucuga

SEQ ID NO: 23095 - RNA, 1410 nt, Artificial Sequence; identical to SEQ ID NO: 23094
  derived and/or modified CDS sequence (AUadapt) from InfluenzaA__AEG65640__NA

SEQ ID NO: 23096 - RNA, 1410 nt, Artificial Sequence; identical to SEQ ID NO: 16537
  derived and/or modified CDS sequence (AUadapt) from InfluenzaA__AEG65651__NA

SEQ ID NO: 23097 - RNA, 1410 nt, Artificial Sequence; identical to SEQ ID NO: 17116
  derived and/or modified CDS sequence (AUadapt) from InfluenzaA__AEG65662__NA

SEQ ID NO: 23098 - RNA, 1410 nt, Artificial Sequence; identical to SEQ ID NO: 17116
  derived and/or modified CDS sequence (AUadapt) from InfluenzaA__AEG65673__NA

SEQ ID NO: 23099 - RNA, 1410 nt, Artificial Sequence; identical to SEQ ID NO: 17116
  derived and/or modified CDS sequence (AUadapt) from InfluenzaA__AEG65684__NA

SEQ ID NO: 23100 - RNA, 1410 nt, Artificial Sequence; identical to SEQ ID NO: 23073
  derived and/or modified CDS sequence (AUadapt) from InfluenzaA__AEG65695__NA

SEQ ID NO: 23101 - RNA, 1410 nt, Artificial Sequence
  derived and/or modified CDS sequence (AUadapt) from InfluenzaA__AEG65706__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaacgaggugcuguggaccuccaacagcaucgucguguucugcggcaccuccgggaccuacggcacggggagcuggccggacggcgccgacaucaaccugaugcccaucuga

SEQ ID NO: 23102 - RNA, 1410 nt, Artificial Sequence
  derived and/or modified CDS sequence (AUadapt) from InfluenzaA__AEG65728__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcaacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccacgaccgcaccccguaccggacccugcucaugaacgagcugggcgugcccuuccaccugggcacgaagcaggucugcaucgccuggagcuccucguccugccacgacgggaaggccuggcuccacgugugcgugaccggcgacgacaagaacgcgaccgccagcuucaucuacaacgggcgccugguggacuccaucgucagcugguccaaggagauccugcggacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgcuaccccggcguccggugcgugugccgcgacaacuggaaggggucgaaccggccgaucguggacaucaacaucaaggacuacuccaucgucagcuccuacgugugcucgggccuggugggcgacacgccccgcaagaacgacuccagcuccagcucccacugccucgaccccaacaacgaggagggcgggcacggggucaagggcugggccuucgacgacgggaacgacguguggaugggccggaccaucucggagaagcugcgcuccggcuacgagaccuucaaggucaucgagggguggagcaaccccaacuccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggccggacggcgccgagaucaaccugaugcccaucuga

SEQ ID NO: 23103 - RNA, 1410 nt, Artificial Sequence
  derived and/or modified CDS sequence (AUadapt) from InfluenzaA__AEG65739__NA
augaaccccaaccagaagaucaucaccaucggcucggugucccugaccaucagcacgaucugcuucuucaugcagaucgccauccucaucaccaccgucacccugcacuucaagcaguacgaguucuccucgccgcccaacaaccaggugaugcccugcgagcccacgaucaucgagcgcaacaucaccgagaucguguaccugaccaacaccacgaucgagaaggagaucugcccgaagcucgccgaguaccggaacugguccaagccccagugcgacaucaccggguucgcgcccuucagcaaggacaacuccauccgccugucggccggcggggacaucugggucacccgggagcccuacguguccugcgacccggacaagugcuaccaguucgcccugggccaggggaccacgcucaacaacgugcacagcaacgacaccguccacgaccgcacccccuaccggacccugcugaugaacgagcucggcgugcccuuccaccugggcacgaagcaggucugcaucgccugguccucguccagcugccacgacgggaaggccuggcugcacgugugcgugaccggcgacgacaagaacgcgaccgccuccuucaucuacaacgggcgccucguggacagcaucgucuccuggucgaaggagauccugcggacccaggaguccgagugcgugugcaucaacggcacgugcaccguggucaugaccgacgggagcgccucgggcaaggccgacaccaagauccuguucaucgaggagggcaagaucgugcacacguccacccucagcggguccgcgcagcacguggaggagugcucgugcuacccccgcuacccgggcguccggugcgugugccgcgacaacuggaagggguccaaccggcccaucguggacaucaacaugaaggacuacagcaucgucuccucguacgugugcuccggccuggugggcgacacgccccgcaagaacgacagcuccagcuccucgcacugccuggaccccaacaacgaggagggcgggcacggggucaagggcugggccuucgacgacgggaacgacguguggaugggccggaccaucuccgagaagcuccgcagcggcuacgagaccuucaaggucaucgaggggugguccaacccgaacucgaagcugcagaucaaccgccaggugaucguggaccggggcaaccgguccggguacagcggcaucuucucggucgaggggaaguccugcaucaaccgcugcuucuacguggagcugauccggggccgcaaggaggagaccgaggugcucuggaccagcaacuccaucgucguguucugcggcaccagcgggacguacggcaccggguccuggcccgacggcgccgacaucaaccugaugcccaucuga

SEQ ID NO: 23104 - RNA, 1410 nt, Artificial Sequence; identical to SEQ ID NO: 18966
  derived and/or modified CDS sequence (AUadapt) from InfluenzaA__AEG65750__NA

SEQ ID NO: 23105 - RNA, 1410 nt, Artificial Sequence; identical to SEQ ID NO: 23102
  derived and/or modified CDS sequence (AUadapt) from InfluenzaA__AEG65761__NA

SEQ ID NO: 23106 - RNA, 1410 nt, Artificial Sequence
  derived and/or modified CDS sequence (AUadapt) from InfluenzaA__AEG65772__NA
augaaccccaaccagaagaucaucaccaucggcucggugucccugaccaucagcacgaucugcuucuucaugcagaccgccauccucaucaccaccgucacgcugcacuucaagcaguacgaguucaacuccccgcccaacaaccaggugaugcugugcgagcccaccaucaucgagcgcaacaucaccgagaucguguaccucaccaacacgaccaucgagaaggagaugugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggacgacccugaacaacgugcacuccaacgacaccguccacgaccgcaccccguaccggacgcugcucaugaacgagcugggcgugcccuuccaccugggcaccaagcaggucugcaucgccuggagcuccucguccugccacgacgggaaggccuggcuccacgugugcgugaccggcgacgacaagaacgcgaccgccagcuucaucuacaacgggcgccugguggacuccaucgucucgugguccaagaagauccugcggacgcaggagagcgagugcgugugcaucaacgggaccugcaccguggucaugaccgacggguccgccucgggcaaggccgacacgaagauccucuucaucgaggagggcaagaucauccacaccagcacccuguccgggucggcgcagcacguggaggagugcuccugcuacccccgcuaccccggcgugcggugcgucugccgcgacaacuggaaggggagcaaccggccgaucguggacaucaacaucaaggacuacuccaucgugucguccuacgucugcagcggccuggugggcgacacgccccgcaagaacgacuccucguccagcucccacugccucgaccccaacaacgaggagggcggccacggggugaagggcugggccuucgacgacgggaacgacgucuggaugggccggaccaucucggagaagcugcgcuccggcuacgagaccuucaaggugaucgagggguggagcaagcccaacuccaagcugcagaucaaccggcaggucaucguggaccgcggcaaccggucgggguacuccggcaucuucagcguggagggcaagucgugcaucaaccgcugcuucuacgucgagcucauccgggggcgcaaggaggagaccgaggugcuguggaccuccaacagcaucguggucuucugcggcacguccgggaccuacggcaccgggagcuggccggacggcgccgacaucaaccugaugcccaucuga

SEQ ID NO: 23107 - RNA, 1410 nt, Artificial Sequence; identical to SEQ ID NO: 21920
  derived and/or modified CDS sequence (AUadapt) from InfluenzaA__AEG65783__NA

SEQ ID NO: 23108 - RNA, 1410 nt, Artificial Sequence
  derived and/or modified CDS sequence (AUadapt) from InfluenzaA__AEG65794__NA
augaaccccaaccagaagaucaucaccaucggcucggugucccugaccaucagcacgaucugcuucuucaugcagaucgccauccucaucaccaccaucacccugcacuucaagcaguacgaguucaacuccccgcccaacaaccaggucaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgucucgugcgaccccgacaagugcuaccaguucgcccucggccaggggaccacgcugaacaacgugcacuccaacaacaccgugcgcgaccggaccccguaccgcacccugcucaugaacgagcugggcguccccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggucaucguggacaagggcaaccgguccggguacucgggcaucuucuccguggagggcaagagcugcaucaaccgcugcuucuacgucgagcucauccgggggcgcaaggaggagaccgaggugcuguggaccucgaacuccaucguggucuucugcggcacgagcgggaccuacggcaccggguccuggccggacggcgccgaccugaaccucaugcccaucuga

SEQ ID NO: 23109 - RNA, 1410 nt, Artificial Sequence; identical to SEQ ID NO: 21920
  derived and/or modified CDS sequence (AUadapt) from InfluenzaA__AEG65805__NA

SEQ ID NO: 23110 - RNA, 1410 nt, Artificial Sequence
  derived and/or modified CDS sequence (AUadapt) from InfluenzaA__AEG65816__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcgaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 23111 - RNA, 1410 nt, Artificial Sequence
  derived and/or modified CDS sequence (AUadapt) from InfluenzaA__AEG79808__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23112 - RNA, 1410 nt, Artificial Sequence; identical to SEQ ID NO: 23111
  derived and/or modified CDS sequence (AUadapt) from InfluenzaA__AEG79814__NA

SEQ ID NO: 23113 - RNA, 1410 nt, Artificial Sequence
  derived and/or modified CDS sequence (AUadapt) from InfluenzaA__AEG79826__NA
augaaccccaaccagaagaucaucaccaucucguccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagucggagugcgcgugcgugaacggcuccugcuucaccaucaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccuggguguccuucaaccagaaccucgaguaccagaucggcuacaucugcucggggaucuucggcgacaacccgcggcccaacgacaagaccggguccugcggccccgucagcuccaacggcgccaacggggugaagggcuucagcuucaaguacgggaacggcguguggaucgggcgcaccaagagcaucuccagccggaagggcuucgagaugaucugggaccccaacggcuggaccgggaccgacaacaacuucuccaucaagcaggacaucgucggcaucaacgaguggucgggguacuccggcagcuucgugcagcacccggagcugacggggcuggacugcauccgccccugcuucuggguggagcucauccggggccgccccaaggagaacaccaucuggaccuccggcagcuccaucagcuucugcggggucaacuccgacaccaugggcuggagcuggcccgacggggccgagcugccguucacgaucgacaaguga

SEQ ID NO: 23114 - RNA, 1410 nt, Artificial Sequence
  derived and/or modified CDS sequence (AUadapt) from InfluenzaA__AEG79830__NA
augaaccccaaccagaagaucaucaccaucucguccgugugcaugaccaucggcauggccaaccugauccuccagaucgggaacaucaucagcaucuggaucucccacagcauccagcugggcaaccagaaccagaucgagacgugcaaccaguccgucaucaccuacgagaacaacaccugggugaaccagaccuacgugaacaucagcaacacgaacuucgccgcggggcaguccgucgugucggugaagcuggccggcaacuccagccucugcccggucuccgggugggccaucuacagcaaggacaacuccauccgcaucggcagcaagggcgacguguucgugauccgggagcccuucaucuccugcagcccccuggagugccgcaccuucuuccugacccagggggcccuccugaacgacaagcacuccaacggcaccaucaaggaccggucgcccuaccgcacgcugauguccugcccgaucggggagguccccagccccuacaacagccgguucgaguccguggccuggagcgcguccgccugccacgacggcaucaacuggcucaccaucgggaucagcggccccgacaacggcgccguggccguccugaaguacaacgggaucaucaccgacaccaucaaguccuggcgcaacaacauccugcggacgcaggagucggagugcgcgugcgugaacggcuccugcuucaccgugaugaccgacgggccgagcgacggccaggccuccuacaagaucuuccgcaucgagaagggcaagaucgucaagagcguggagaugaacgcccccaacuaccacuacgaggagugcuccugcuaccccgacagcuccgagaucacgugcgugugccgggacaacuggcacgggagcaaccgccccugggucuccuucaaccagaaccucgaguaccagaucggcuacaucugcucggggaucuucggcgacaacccgcggcccaacgacaagaccggguccugcggccccgugagcuccaacggcgccaacggggugaagggcuucagcuucaaguacgggaacggcgucuggaucgggcgcaccaagagcaucuccagccggaagggcuucgagaugaucugggaccccaacggcuggaccgggaccgacaacaacuucuccaucaagcaggacaucgugggcaucaacgaguggucgggguacuccggcagcuucgugcagcacccggagcugacggggcuggacugcauccgccccugcuucugggucgagcucauccggggccgccccaaggagaacaccaucuggaccuccggcagcuccaucagcuucugcggggugaacuccgacaccgucggcuggagcuggcccgacggggccgagcugccguucacgaucgacaaguga

SEQ ID NO: 23115 - RNA, 1410 nt, Artificial Sequence; identical to SEQ ID NO: 22659
  derived and/or modified CDS sequence (AUadapt) from InfluenzaA__AEG79836__NA

SEQ ID NO: 23116 - RNA, 1410 nt, Artificial Sequence
  derived and/or modified CDS sequence (AUadapt) from InfluenzaA__AEH59356__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcacccuccugaacgacaagcacuccaacgggacgaucaaggaccggucccccuaccgcacccugaugagcugcccgaucggcgagguccccucccccuacaacagccgguucgagucgguggccugguccgccagcgcgugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgccugcgugaacgggagcugcuucaccaucaugaccgacggcccguccgacggccaggcgagcuacaagaucuuccgcaucgagaaggggaagaucgugaaguccgucgagaugaacgcccccaacuacuacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcacggacaacaacuucagcaucaagcaggacaucgucgggaucaacgagugguccggcuacagcggguccuucgugcagcacccggagcugaccggccuggacugcauccgccccugcuucuggguggagcucauccggggccgccccaaggagaacaccgucuggaccagcggguccagcaucuccuucugcggcgugaacagcgacacggucgggugguccuggcccgacggcgccgagcugccguucaccaucgacaaguga

SEQ ID NO: 23117 - RNA, 1410 nt, Artificial Sequence; identical to SEQ ID NO: 23111
  derived and/or modified CDS sequence (AUadapt) from InfluenzaA__AEH59360__NA

SEQ ID NO: 23118 - RNA, 1410 nt, Artificial Sequence
  derived and/or modified CDS sequence (AUadapt) from InfluenzaA__AEH59364__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcgccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucuccagccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 23119 - RNA, 1410 nt, Artificial Sequence
  derived and/or modified CDS sequence (AUadapt) from InfluenzaA__AEH59366__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgggguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcucgugcuucaccaucaugaccgacggcccguccgacgggcaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugucguucaaccagaaccucgaguaccagaucggcuacaucugcuccgggaucuucggcgacaacccgcggcccaacgacaagaccggcagcugcgggcccgucuccagcaacggcgccaacggggugaagggcuucuccuucaaguacgggaacggcguguggaucggccgcaccaagagcaucagcucccggaagggguucgagaugaucugggaccccaacggcuggaccgggaccgacaacaacuucucgaucaagcaggacaucgucggcaucaacgagugguccggguacagcggcuccuucgugcagcacccggagcugacgggccuggacugcauccgccccugcuucuggguggagcucauccgggggcgccccaaggagaacaccaucuggaccagcggcuccagcaucuccuucugcggggucaacagcgacaccgugggcugguccuggcccgacggcgccgagcugccguucacgaucgacaaguga

SEQ ID NO: 23120 - RNA, 1410 nt, Artificial Sequence; identical to SEQ ID NO: 23111
  derived and/or modified CDS sequence (AUadapt) from InfluenzaA__AEH59368__NA

SEQ ID NO: 23121 - RNA, 1410 nt, Artificial Sequence; identical to SEQ ID NO: 22659
  derived and/or modified CDS sequence (AUadapt) from InfluenzaA__AEH59370__NA

SEQ ID NO: 23122 - RNA, 1410 nt, Artificial Sequence; identical to SEQ ID NO: 23118
  derived and/or modified CDS sequence (AUadapt) from InfluenzaA__AEH59372__NA

SEQ ID NO: 23123 - RNA, 1410 nt, Artificial Sequence; identical to SEQ ID NO: 23118
  derived and/or modified CDS sequence (AUadapt) from InfluenzaA__AEH59376__NA

SEQ ID NO: 23124 - RNA, 1410 nt, Artificial Sequence; identical to SEQ ID NO: 22659
  derived and/or modified CDS sequence (AUadapt) from InfluenzaA__AEH59378__NA

SEQ ID NO: 23125 - RNA, 1410 nt, Artificial Sequence; identical to SEQ ID NO: 23118
  derived and/or modified CDS sequence (AUadapt) from InfluenzaA__AEH59382__NA

SEQ ID NO: 23126 - RNA, 1410 nt, Artificial Sequence
  derived and/or modified CDS sequence (AUadapt) from InfluenzaA__AEH59384__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggcggaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcucgggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccggcccugcuucuggguggagcucauccgcggccggcccaaggagaacaccaucuggaccuccgggagcuccaucagcuucugcggcgucaacuccgacaccgugggguggagcuggcccgacggcgccgagcugccguucacgaucgacaaguga

SEQ ID NO: 23127 - RNA, 1410 nt, Artificial Sequence
  derived and/or modified CDS sequence (AUadapt) from InfluenzaA__AEH59386__NA
augaaccccaaccagaagaucaucaccaucggcucggugugcaugaccaucgggauggccaaccugauccuccagaucggcaacaucaucuccaucuggaucagccacuccauccagaucgggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccugugcccggucagcggcugggccaucuacuccaaggacaacagcauccgcaucggcuccaagggggacguguucgugauccgggagcccuucaucagcugcagcccccucgagugccgcaccuucuuccugacccagggcgcccugcucaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcugaccaucggcaucuccggccccgacaacggggccguggccguccucaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccuggaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcucacgggccuggacugcauccgccccugcuucuggguggagcugauccggggccgccccaaggagaacaccaucuggaccagcggguccagcaucuccuucugcggcgucaacagcgacaccguggggugguccuggcccgacggcgccgagcucccguucacgaucgacaaguga

SEQ ID NO: 23128 - RNA, 1410 nt, Artificial Sequence; identical to SEQ ID NO: 23118
  derived and/or modified CDS sequence (AUadapt) from InfluenzaA__AEH59388__NA

SEQ ID NO: 23129 - RNA, 1410 nt, Artificial Sequence
  derived and/or modified CDS sequence (AUadapt) from InfluenzaA__AEH59390__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuccaacggggccaacggcgugaagggguucagcuucaaguacggcaacgggguguggaucggccgcaccaagagcaucuccucgcggaagggcuucgagaugaucugggaccccaacggguggaccggcaccgacaacaacuucuccaucaagcaggacaucgucgggcugaacgaguggagcggcuacuccgggagcuucgugcagcacccggagcugacgggccucgacugcauccgccccugcuucuggguggagcugauccggggccugcccaaggagaacaccaucuggaccuccgggagcuccaucagcuucugcggcgucaacuccgacaccgugggguggagcuggcccgacggcgccgagcucccguucacgaucgacaaguga

SEQ ID NO: 23130 - RNA, 1410 nt, Artificial Sequence; identical to SEQ ID NO: 23118
  derived and/or modified CDS sequence (AUadapt) from InfluenzaA__AEH59392__NA

SEQ ID NO: 23131 - RNA, 1410 nt, Artificial Sequence; identical to SEQ ID NO: 23118
  derived and/or modified CDS sequence (AUadapt) from InfluenzaA__AEH59396__NA

SEQ ID NO: 23132 - RNA, 1410 nt, Artificial Sequence
  derived and/or modified CDS sequence (AUadapt) from InfluenzaA__AEH59398__NA
augaaccccaaccagaagaucaucaccaucggcucggugugcaugaccaucggggucgccaaccugauccuccagaucggcaacaucaucuccaucuggaucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacagcucccucugcccggugucgggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucgguggccugguccgcgagcgccugccacgacgggaucaacuggcucaccaucggcaucuccggccccgacaacggggccgucgccgugcugaaguacaacggcaucaucaccgacaccaucaagagcuggcgcaacuacauccugcggacgcaggaguccgagugcgcgugcgugaacgggagcugcuucaccaucaugaccgacggcccguccgacggccaggccagcuacaagaucuuccgcaucgagaaggggaaggucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucucgucccggaagggcuucgagaugaucugggaccccaacggguggaccggcaccgacaacaacuucagcaucaagcaggacaucaucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23133 - RNA, 1410 nt, Artificial Sequence
  derived and/or modified CDS sequence (AUadapt) from InfluenzaA__AEH59400__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgaacgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 23134 - RNA, 1410 nt, Artificial Sequence
  derived and/or modified CDS sequence (AUadapt) from InfluenzaA__AEH59402__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccgaacgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcgccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucuccagccggaacggcuucgagaugaucugggaccccaacggguggaccgagaccgacaacaacuucagcaucaagcaggacaucgugggcaucaacgagugguccggguacucgggcuccuucgugcagcacccggagcugacggggcuggacugcauccgccccugcuucugggucgagcucauccggggccgccccaaggagaacaccaucuggaccagcggcuccagcaucuccuucugcggggugaacagcgacaccgucggcugguccuggcccgacggggcggagcugccguucacgaucgacaaguga

SEQ ID NO: 23135 - RNA, 1410 nt, Artificial Sequence
  derived and/or modified CDS sequence (AUadapt) from InfluenzaA__AEH59404__NA
augaaccccaaccagaagaucaucaccaucggcucggccugcaugaccaucgggauggccaaccugauccuccagaucggcaacaucaucuccaucuggaucagccacuccauccagcuggggaaccagagccagaucgagacgugcaaccaguccgugaucaccuacgagaacaacaccugggucaaccagaccuacgugaacaucagcaacacgaacuucgcggccggccagccgguggucuccgugaagcuggccgggaacucgucccucugccccgugagcggcugggccaucuacuccaaggacaacagcauccgcaucggcuccaagggggacgucuucgugauccgggagcccuucaucagcugcucgccccuggagugccgcaccuucuuccugacccagggcgcccuccugaacgacaagcacuccaacgggaccaucaaggaccgguccccguaccgcacgcugaugagcugccccaucggcgaggugcccucccccuacaacagccgguucgagagcgucgcgugguccgccucggccugccacgacgggaucaacuggcucaccaucggcaucuccggcccggacaacggggccguggcggugcugaaguacaacggcaucaucaccgacaccaucaagagcuggcgcaacaacauccugcggacgcaggaguccgagugcgccugcgucaacgggagcugcuucaccaucaugaccgacggccccuccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgcccgugggugagcuucaaccagaaccucgaguaccagaucggguacaucugcuccggcaucuucggggacaacccccggcccaacgacaagaccggcagcugcggccccguguccucgaacggggccaacggcgucaagggguucuccuucaaguacggcaacgggguguggaucggccgcaccaagagcaucagcucccggaagggcuucgagaugaucugggacccgaacggguggaccggcaccgacaacaacuucagcaucaagcaggacaucguggggaucaacgagugguccggcuacucgggguccuucguccagcaccccgagcugacgggccuggacugcauccgccccugcuucuggguggagcucauccggggccgccccaaggagaacaccaucuggaccagcggguccagcaucuccuucugcggcgugaacagcgacaccgucgggugguccuggccggacggcgcggagcugcccuucacgaucgacaaguga

SEQ ID NO: 23136 - RNA, 1410 nt, Artificial Sequence
  derived and/or modified CDS sequence (AUadapt) from InfluenzaA__AEH59406__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccagccucugcccggucuccggcugggccaucuacagcaaggacaacuccauccgcaucggcucgaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaccuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucagcuucaacggggccaacggcgugaagggguucuccuucaaguacggcaacgggguguggaucggccgcaccaagucgaucagcucccggaagggcuucgagaugaucugggaccccaacggguggaccggcacggacaacaacuucagcaucaagcaggacaucgucgggaucgacgagugguccggcuacagcggguccuucgugcagcacccggagcugaccggccuggacugcauccgccccugcuucuggguggagcucauccggggccgccccaaggagaacaccaucuggaccagcggguccagcaucuccuucugcggcgucaacagcgacacgguggggugguccuggcccgacggcgccgagcugccguucaccaucgacaaguga

SEQ ID NO: 23137 - RNA, 1410 nt, Artificial Sequence; identical to SEQ ID NO: 22659
  derived and/or modified CDS sequence (AUadapt) from InfluenzaA__AEH59408__NA

SEQ ID NO: 23138 - RNA, 1410 nt, Artificial Sequence
  derived and/or modified CDS sequence (AUadapt) from InfluenzaA__AEH59412__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccauccgcuccuggcggaacaacauccugcgcacgcaggagagcgagugcgcgugcgugaacggguccugcuucaccaucaugaccgacggcccgagcgacggccaggccuccuacaagaucuuccggaucgagaaggggaagaucaucaagucgguggagaugaacgcccccaacuaccacuacgaggagugcuccugcuaccccgacagcuccgagaucacgugcgucugccgcgacaacuggcacggcagcaaccggcccuggguguccuucaaccagaaccucgaguaccagaucggguacaucugcagcggcaucuucggggacaacccgcgccccaacgacaagaccggcuccugcggccccgugcugagcaacggggccaacggcgucaagggguucuccuucaaguacggcaacgggguguggaucggccggaccaagagcaucucgucccgcaagggcuucgagaugaucugggaccccaacggguggaccggcaccgacaacaacuucagcaucaagcaggacaucguggggaucaacgagugguccggcuacagcggguccuucguccagcacccggagcugacgggccucgacugcauccggcccugcuucuggguggagcugauccgcggccggcccaaggagaacaccaucuggaccagcggguccagcaucuccuucugcggcgugaacagcgacaccgucgggugguccuggcccgacggcgccgagcugccguucacgaucgacaaguga

SEQ ID NO: 23139 - RNA, 1410 nt, Artificial Sequence; identical to SEQ ID NO: 23111
  derived and/or modified CDS sequence (AUadapt) from InfluenzaA__AEH59416__NA

SEQ ID NO: 23140 - RNA, 1410 nt, Artificial Sequence; identical to SEQ ID NO: 16318
  derived and/or modified CDS sequence (AUadapt) from InfluenzaA__AEH59584__NA

SEQ ID NO: 23141 - RNA, 1410 nt, Artificial Sequence; identical to SEQ ID NO: 16318
  derived and/or modified CDS sequence (AUadapt) from InfluenzaA__AEH59586__NA

SEQ ID NO: 23142 - RNA, 1410 nt, Artificial Sequence; identical to SEQ ID NO: 16318
  derived and/or modified CDS sequence (AUadapt) from InfluenzaA__AEH59588__NA

SEQ ID NO: 23143 - RNA, 1410 nt, Artificial Sequence; identical to SEQ ID NO: 16318
  derived and/or modified CDS sequence (AUadapt) from InfluenzaA__AEH59592__NA

SEQ ID NO: 23144 - RNA, 1410 nt, Artificial Sequence; identical to SEQ ID NO: 16318
  derived and/or modified CDS sequence (AUadapt) from InfluenzaA__AEH59594__NA

SEQ ID NO: 23145 - RNA, 1410 nt, Artificial Sequence; identical to SEQ ID NO: 16318
  derived and/or modified CDS sequence (AUadapt) from InfluenzaA__AEH59596__NA

SEQ ID NO: 23146 - RNA, 1410 nt, Artificial Sequence; identical to SEQ ID NO: 16318
  derived and/or modified CDS sequence (AUadapt) from InfluenzaA__AEH59598__NA

SEQ ID NO: 23147 - RNA, 1410 nt, Artificial Sequence; identical to SEQ ID NO: 16318
  derived and/or modified CDS sequence (AUadapt) from InfluenzaA__AEH59600__NA

SEQ ID NO: 23148 - RNA, 1410 nt, Artificial Sequence
  derived and/or modified CDS sequence (AUadapt) from InfluenzaA__AEH59602__NA
augaaccccaaccagaagaucaucaccaucggcucggugugcaugaccaucgggauggccaaccugauccuccagaucggcaacaucaucuccaucuggaucagccacuccauccagcuggggagccagaaccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23149 - RNA, 1410 nt, Artificial Sequence; identical to SEQ ID NO: 16318
  derived and/or modified CDS sequence (AUadapt) from InfluenzaA__AEH59606__NA

SEQ ID NO: 23150 - RNA, 1410 nt, Artificial Sequence; identical to SEQ ID NO: 16318
  derived and/or modified CDS sequence (AUadapt) from InfluenzaA__AEH59616__NA

SEQ ID NO: 23151 - RNA, 1410 nt, Artificial Sequence; identical to SEQ ID NO: 16318
  derived and/or modified CDS sequence (AUadapt) from InfluenzaA__AEH59626__NA

SEQ ID NO: 23152 - RNA, 1413 nt, Artificial Sequence; identical to SEQ ID NO: 19863
  derived and/or modified CDS sequence (AUadapt) from InfluenzaA__AEH77262__NA

SEQ ID NO: 23153 - RNA, 1410 nt, Artificial Sequence
  derived and/or modified CDS sequence (AUadapt) from InfluenzaA__AEH77273__NA
augaaccccaaccagaagaucaucaccaucggcucggugugcaugaccaucgggauggccaaccugauccuccagaucggcaacaucacguccaucuggaucagccacuccauccagcuggggaaccagaaccagaucgagaccugcaaccagagcgucaucaccuacgagaacaacaccugggugaaccagacguacgugaacaucuccaacaccaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcacggacaacaacuucagcaucaagcaggacaucguggggaucaacgagugguccggcuacucgggguccuucgugcagcacccggagcugaccggccuggacugcauccgccccugcuucugggucgagcucauccggggccgccccaaggagaacaccaucuggaccagcggguccagcaucuccuucugcggcgugaacagcgacacggucgggugguccuggcccgacggcgccgagcugccguucaccaucgacaaguga

SEQ ID NO: 23154 - RNA, 1410 nt, Artificial Sequence
  derived and/or modified CDS sequence (AUadapt) from InfluenzaA__AEH77282__NA
augaaccccaaccagaagaucaucaccaucggcucggugucccugaccaucgccacgaucugcuuccucaugcagaucgccauccuggucaccaccgugacccugcacuucaagcagcacgagugcaacucgccgcccaacaaccaggugaugcucugcgagcccacgaucaucgagcgcaacaucaccgagaucgucuaccugaccaacaccacgaucgagaaggagaucugccccaagcuggcggaguaccggaacugguccaagccgcagugcaacaucaccggguucgcccccuucagcaaggacaacuccauccgccucucggccggcggggacaucugggugacccgggagcccuacguguccugcgaccccgacaagugcuaccaguucgcccugggccaggggaccacgcugaacaacggccacucgaacgacaccguccacgaccgcaccccguaccggacccuccugaugaacgagcugggcgugcccuuccaccucgggacgcgccaggugugcaucgccugguccagcuccucgugccacgacggcaaggcguggcugcacgucugcgugaccggggacgacaagaacgccaccgccuccuucaucuacaacggccggcugguggacagcaucggguccuggucgaagaagauccuccgcacccaggaguccgagugcgucugcaucaacggcacgugcaccguggugaugaccgacggcucggccuccgggaaggcggacaccaagauccuguucgucgaggagggcaagaucgugcacaucagcacgcugucgggguccgcccagcacguggaggagugcucgugcuacccccgguaccccggcguccgcugcgugugccgggacaacuggaagggcuccaaccgcccgaucguggacaucaacgucaaggacuacagcaucguguccucguacgugugcuccgggcucgucggcgacacgccccggaagaacgacagcuccucguccucgcacugccuggaccccaacaacgaggagggcgggcacggggugaagggcugggccuucgacgacggcaacgacgucuggauggggcgcaccaucuccgagaagcugcggagcggcuacgagaccuucaaggugaucgaggggugguccaagcccaacucgaagcuccagaucaaccgccaggugaucgucgagcggggcaaccgcuccggguacucgggcaucuucuccguggagggcaagagcugcaucaaccggugcuucuacguggagcugauccgcgggcggaaggaggagaccgaggucugguggaccucgaacuccaucgugguguucugcggcaccagcgggaccuacggcacgggguccuggccggacggcgccgacaucaaccugaugcccaucuga

SEQ ID NO: 23155 - RNA, 1410 nt, Artificial Sequence; identical to SEQ ID NO: 16318
  derived and/or modified CDS sequence (AUadapt) from InfluenzaA__AEI29218__NA

SEQ ID NO: 23156 - RNA, 1410 nt, Artificial Sequence; identical to SEQ ID NO: 20507
  derived and/or modified CDS sequence (AUadapt) from InfluenzaA__AEI29228__NA

SEQ ID NO: 23157 - RNA, 1410 nt, Artificial Sequence; identical to SEQ ID NO: 16539
  derived and/or modified CDS sequence (AUadapt) from InfluenzaA__AEI54350__NA

SEQ ID NO: 23158 - RNA, 1410 nt, Artificial Sequence; identical to SEQ ID NO: 16552
  derived and/or modified CDS sequence (AUadapt) from InfluenzaA__AEI54361__NA

SEQ ID NO: 23159 - RNA, 1410 nt, Artificial Sequence; identical to SEQ ID NO: 17116
  derived and/or modified CDS sequence (AUadapt) from InfluenzaA__AEI54372__NA

SEQ ID NO: 23160 - RNA, 1410 nt, Artificial Sequence; identical to SEQ ID NO: 16993
  derived and/or modified CDS sequence (AUadapt) from InfluenzaA__AEI54383__NA

SEQ ID NO: 23161 - RNA, 1410 nt, Artificial Sequence; identical to SEQ ID NO: 17116
  derived and/or modified CDS sequence (AUadapt) from InfluenzaA__AEI54394__NA

SEQ ID NO: 23162 - RNA, 1410 nt, Artificial Sequence; identical to SEQ ID NO: 18286
  derived and/or modified CDS sequence (AUadapt) from InfluenzaA__AEI54416__NA

SEQ ID NO: 23163 - RNA, 1410 nt, Artificial Sequence; identical to SEQ ID NO: 23106
  derived and/or modified CDS sequence (AUadapt) from InfluenzaA__AEI54427__NA

SEQ ID NO: 23164 - RNA, 1410 nt, Artificial Sequence; identical to SEQ ID NO: 21920
  derived and/or modified CDS sequence (AUadapt) from InfluenzaA__AEI54438__NA

SEQ ID NO: 23165 - RNA, 1410 nt, Artificial Sequence; identical to SEQ ID NO: 21920
  derived and/or modified CDS sequence (AUadapt) from InfluenzaA__AEI54449__NA

SEQ ID NO: 23166 - RNA, 1410 nt, Artificial Sequence; identical to SEQ ID NO: 21920
  derived and/or modified CDS sequence (AUadapt) from InfluenzaA__AEI54460__NA

SEQ ID NO: 23167 - RNA, 1410 nt, Artificial Sequence
  derived and/or modified CDS sequence (AUadapt) from InfluenzaA__AEI54471__NA
augaaccccaaccagaagaucaucaccaucggcucggugucccugaccaucagcacgaucugcuucuucaugcagaucgccguccucaucaccaccgugacccugcacuucaagcaguacaaguucaacuccccgcccaacaaccaggugaugcugugcgagcccacgaucaucgagcgcaacaucaccgagaucgucuaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgagguccuguggaccucgaacuccaucgugguguucugcggcacgagcgggaccuacggcaccggguccuggccggacggcgccgaccugaaccucaugcccaucuga

SEQ ID NO: 23168 - RNA, 1410 nt, Artificial Sequence; identical to SEQ ID NO: 21812
  derived and/or modified CDS sequence (AUadapt) from InfluenzaA__AEI54482__NA

SEQ ID NO: 23169 - RNA, 1410 nt, Artificial Sequence
  derived and/or modified CDS sequence (AUadapt) from InfluenzaA__AEI54493__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcaaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugagcaucuga

SEQ ID NO: 23170 - RNA, 1410 nt, Artificial Sequence; identical to SEQ ID NO: 21920
  derived and/or modified CDS sequence (AUadapt) from InfluenzaA__AEI54504__NA

SEQ ID NO: 23171 - RNA, 1410 nt, Artificial Sequence; identical to SEQ ID NO: 21440
  derived and/or modified CDS sequence (AUadapt) from InfluenzaA__AEI59982__NA

SEQ ID NO: 23172 - RNA, 1413 nt, Artificial Sequence; identical to SEQ ID NO: 22338
  derived and/or modified CDS sequence (AUadapt) from InfluenzaA__AEI59993__NA

SEQ ID NO: 23173 - RNA, 1413 nt, Artificial Sequence; identical to SEQ ID NO: 22334
  derived and/or modified CDS sequence (AUadapt) from InfluenzaA__AEI60004__NA

SEQ ID NO: 23174 - RNA, 1410 nt, Artificial Sequence
  derived and/or modified CDS sequence (AUadapt) from InfluenzaA__AEI60015__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcgggcacugccucgaccccaacaacgaggagggcgggaacggcgucaaggggugggccuucgacgacggcaacgacguguggaugggccgcaccaucuccgagaagucccggcugggguacgagaccuucaaggucaucgagggcuggucgaaccacaagagcaagcugcagaucaaccgccaggugaucguggaccgggggaaccgcuccggcuacucggggaucuucuccgucgagggcaagagcugcaucaaccggugcuucuacguggagcucauccgcggccggaaggaggagaccgaggugcuguggaccucgaacuccaucgucguguucugcgggaccagcggcacguacgggaccggcuccuggcccgacggggccgaccugaaccucaugccgaucuga

SEQ ID NO: 23175 - RNA, 1410 nt, Artificial Sequence; identical to SEQ ID NO: 20886
  derived and/or modified CDS sequence (AUadapt) from InfluenzaA__AEI60026__NA

SEQ ID NO: 23176 - RNA, 1410 nt, Artificial Sequence
  derived and/or modified CDS sequence (AUadapt) from InfluenzaA__AEI60037__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggcgcaacgacuccucguccagcucccacugccucgaccccaacaacgaggagggcgggcacggggucaagggcugggccuucgacgacgggaacgacguguggaugggccggaccaucucggagaagucccgccugggcuacgagaccuucaaggucaucgagggguggagcaaccacaaguccaagcugcagaucaaccgccaggugaucguggaccggggcaaccggucgggguacuccggcaucuucagcgucgagggcaagucgugcaucaaccgcugcuucuacguggagcucauccgggggcgcaaggaggagaccgaggugcuguggaccuccaacagcaucgucguguucugcggcaccuccgggacguacggcaccgggagcuggcccgacggcgccgaccugaaccucaugccgaucuga

SEQ ID NO: 23177 - RNA, 1410 nt, Artificial Sequence
  derived and/or modified CDS sequence (AUadapt) from InfluenzaA__AEI60048__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgcccccacgaucaucgagcgcaacaucaccgagaucguguaccucaccaacaccacgaucgagaaggagaucugccccaagcuggcggaguaccggaacuggucgaagccgcagugcgacaucaccggguucgcccccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggcguggcuccacgugugcaucaccggcgacgacaagaacgccaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggcggacaccaagauccucuucaucgaggagggcaagaucgugcacacgagcacccuguccgggucggcccagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 23178 - RNA, 1410 nt, Artificial Sequence
  derived and/or modified CDS sequence (AUadapt) from InfluenzaA__AEI60089__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuacuacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23179 - RNA, 1410 nt, Artificial Sequence; identical to SEQ ID NO: 23111
  derived and/or modified CDS sequence (AUadapt) from InfluenzaA__AEI60099__NA

SEQ ID NO: 23180 - RNA, 1410 nt, Artificial Sequence
  derived and/or modified CDS sequence (AUadapt) from InfluenzaA__AEI60111__NA
augaaccccaaccagaagaucaucaccaucggcucgaucucccugaccaucgccacgaucugcuuccucaugcagaucgccauccuggugaccaccgucacccugcacuucaagcaguacaagugcaacucgccgcccaacaaccgcgugaugcucugcgagcccacgaucaucgagcggaacaucaccgagaucguguaccugaccaacaccacgaucgagaaggagaucugccccaagcuggcggaguaccgcaacugguccaagccgcagugcaacaucaagggguucgcccccuucagcaaggacaacuccauccggcucucggccggcggggacaucugggucacccgcgagcccuacguguccugcgaccccgacaagugcuaccaguucgcccugggccaggggaccacccugaacaacggccacagcaacgacacggugcacgaccggaccccguaccgcacccuccugaugaacgagcugggcguccccuuccaccucgggacccgccaggugugcaucgccugguccucguccagcugccacgacggcaaggcguggcugcacgugugcaucacgggggacgacgagaacgccaccgccuccuucaucuacaacggccggcuggucgacucgaucggguccuggagcaagaagauccuccggacccaggaguccgagugcgugugcaucaacgggaccugcacgguggucaugaccgacggcucggccuccgggaaggcggacaccaagauccuguucaucgaggagggcaagaucgugcacaucagcacccugucgggguccgcccagcacguggaggagugcucgugcuacccccgcuaccccggcguccggugcgugugccgcgacaacuggaagggcuccaaccggccgaucguggacaucaacguccgcgacuacagcaucguguccucguacgugugcuccgggcucgucggcgacacgccccggaagaacgacagcuucuccucgucccacugccuggaccccaacaacgaggagggcggccacggggugaagggcugggccuucgacgacggcaacgacguguggauggggcgcaccaucagcgagaagcugcgguccggcuacgagaccuucaaggucaucgagggguggucgaagcccaacuccaagcuccaggugaaccgccaggucaucguggagcggggcaaccgcagcggguacuccggcaucuucucgguggagggcaaguccugcaucaaccggugcuucuacgucgagcugauccgcgggcgcaaggaggagaccaaggugugguggacgagcaacucgaucguggucuucugcggcaccuccgggaccuacggcaccgggagcuggccggacggcgccgacaucaacaucaugcccaucuga

SEQ ID NO: 23181 - RNA, 1410 nt, Artificial Sequence; identical to SEQ ID NO: 16318
  derived and/or modified CDS sequence (AUadapt) from InfluenzaA__AEI73669__NA

SEQ ID NO: 23182 - RNA, 1410 nt, Artificial Sequence
  derived and/or modified CDS sequence (AUadapt) from InfluenzaA__AEI86727__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagcaaguucgagagcguggccugguccgcgagcgccugccacgacgggaucuccuggcucaccaucggcaucagcggccccgacaacggggccguggccguccugaaguacaacggcaucaucaccgacaccaucaaguccuggcggaacaacauccugcgcacgcaggagucggagugcgcgugcgugaacggguccugcuucaccgugaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 23183 - RNA, 1410 nt, Artificial Sequence
  derived and/or modified CDS sequence (AUadapt) from InfluenzaA__AEI86737__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaaggucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23184 - RNA, 1410 nt, Artificial Sequence
  derived and/or modified CDS sequence (AUadapt) from InfluenzaA__AEI86757__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagucgaucaucucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23185 - RNA, 1410 nt, Artificial Sequence
  derived and/or modified CDS sequence (AUadapt) from InfluenzaA__AEI86767__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccacaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23186 - RNA, 1410 nt, Artificial Sequence; identical to SEQ ID NO: 23185
  derived and/or modified CDS sequence (AUadapt) from InfluenzaA__AEI86777__NA

SEQ ID NO: 23187 - RNA, 1410 nt, Artificial Sequence
  derived and/or modified CDS sequence (AUadapt) from InfluenzaA__AEI86787__NA
augaaccccaaccagaagaucaucaccaucggcucggugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23188 - RNA, 1410 nt, Artificial Sequence
  derived and/or modified CDS sequence (AUadapt) from InfluenzaA__AEI86797__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23189 - RNA, 1410 nt, Artificial Sequence
  derived and/or modified CDS sequence (AUadapt) from InfluenzaA__AEI86807__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcaagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucaucaucgacaaguga

SEQ ID NO: 23190 - RNA, 1410 nt, Artificial Sequence; identical to SEQ ID NO: 23185
  derived and/or modified CDS sequence (AUadapt) from InfluenzaA__AEI86817__NA

SEQ ID NO: 23191 - RNA, 1410 nt, Artificial Sequence
  derived and/or modified CDS sequence (AUadapt) from InfluenzaA__AEI86827__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccacaaccucgaguaccagaucggguacaucugcagcggcaucuucggggacaacccgcggcccaacgacaagaccggcuccugcggccccgugucguccaacggggccaacggcgugaagggguucagcuucaaguacggcaacggggucuggaucggccgcaccaagagcaccuccagccggaacggcuucgagaugaucugggaccccaacggguggaccggcacggacaacaacuucuccaucaagcaggacaucguggggaucaacgaguggucgggcuacuccgggagcuucgugcagcacccggagcugaccggccugaacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 23192 - RNA, 1410 nt, Artificial Sequence; identical to SEQ ID NO: 23188
  derived and/or modified CDS sequence (AUadapt) from InfluenzaA__AEI86837__NA

SEQ ID NO: 23193 - RNA, 1410 nt, Artificial Sequence; identical to SEQ ID NO: 22659
  derived and/or modified CDS sequence (AUadapt) from InfluenzaA__AEI86847__NA

SEQ ID NO: 23194 - RNA, 1410 nt, Artificial Sequence
  derived and/or modified CDS sequence (AUadapt) from InfluenzaA__AEI86867__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaaccuggccgcgggccagagcgucguguccgugaagcucgccgggaacucgucccugugcccggucagcggcugggccaucuacuccaaggacaacagcauccgcaucggcuccaagggggacguguucgugauccgggagcccuucaucagcugcucgccccuggagugccgcaccuucuuccucacccagggcgcccugcugaacgacaagcacuccaacgggaccaucaaggaccggucccccuaccgcacgcucaugagcugcccgaucggcgagguccccucccccuacaacagcaaguucgagagcguggccugguccgcgucggccugccacgacgggaucaacuggcugaccaucggcaucuccggccccgacaacggggccguggccguccugaaguacaacggcaucaucaccgacaccaucaagagcuggcggaacaacauccuccgcacgcaggaguccgagugcgcgugcgugaacgggagcugcuucaccaucaugaccgacggcccguccgacggccaggccagcuacaagaucuuccggaucgagaaggggaagaucgugaaguccgucgagaugaacgcccccaacuaccacuacgaggagugcucgugcuaccccgacuccagcgagaucacgugcgugugccgcgacaacuggcacggcuccaaccggcccugggugagcuucaaccagaaccuggaguaccagaucggguacaucugcuccggcaucuucggggacaacccgcgccccaacgacaagaccggcagcugcggccccgucuccucgaacggggccaacggcgugaagggguucuccuucaaguacggcaacgggguguggaucggccggaccaagagcaucagcucccgcaagggcuucgagaugaucugggaccccaacggguggaccggcaccgacaacaacuucagcaucaagcaggacaucgucgggaucaacgagugguccggcuacucgggguccuucgugcagcacccggagcugacgggccucgacugcauccggcccugcuucuggguggagcugauccgcggccggcccaaggagaacaccaucuggaccagcggguccagcaucuccuucugcggcgucaacagcgacaccguggggugguccuggcccgacggcgccgagcugccguucacgaucgacaaguga

SEQ ID NO: 23195 - RNA, 1410 nt, Artificial Sequence; identical to SEQ ID NO: 23188
  derived and/or modified CDS sequence (AUadapt) from InfluenzaA__AEI86887__NA

SEQ ID NO: 23196 - RNA, 1410 nt, Artificial Sequence; identical to SEQ ID NO: 23188
  derived and/or modified CDS sequence (AUadapt) from InfluenzaA__AEI86897__NA

SEQ ID NO: 23197 - RNA, 1410 nt, Artificial Sequence
  derived and/or modified CDS sequence (AUadapt) from InfluenzaA__AEI86907__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacauccacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccaucaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaagggcuucgagaugaucugggaccccaacggguggaccggcaccgacaacaacuucagcaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23198 - RNA, 1410 nt, Artificial Sequence
  derived and/or modified CDS sequence (AUadapt) from InfluenzaA__AEI86917__NA
augaaccccaaccagaagaucaucaccaucggcucgaucugcaugaccaucgggauggccaaccugauccuccagaucggcaacaucaucuccaucuggaucagccacuccauccagcuggggaaccagaaccagaucgagacgugcaaccagagcgugaucaccuacgagaacaacaccugggucaaccagaccuacgugaacaucuccaacacgaacuucgccgcgggccagagcguggucuccgugaagcuggccgggaacucgucccucugcccggugagcggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcgucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggucgugcuucaccaucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaagggcuucgagaugaucugggaccccaacggguggaccggcaccgacaacaacuucucgaucaagcaggacaucguggggaucaacgagugguccggcuacagcggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23199 - RNA, 1410 nt, Artificial Sequence; identical to SEQ ID NO: 23111
  derived and/or modified CDS sequence (AUadapt) from InfluenzaA__AEI86927__NA

SEQ ID NO: 23200 - RNA, 1410 nt, Artificial Sequence; identical to SEQ ID NO: 23185
  derived and/or modified CDS sequence (AUadapt) from InfluenzaA__AEI86937__NA

SEQ ID NO: 23201 - RNA, 1410 nt, Artificial Sequence
  derived and/or modified CDS sequence (AUadapt) from InfluenzaA__AEI86947__NA
augaaccccaaccagaagaucaucaccaucggcucggugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaaggagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23202 - RNA, 1410 nt, Artificial Sequence
  derived and/or modified CDS sequence (AUadapt) from InfluenzaA__AEI86967__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacgccuucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcgucgcgugguccgccucggccugccacgacgggaucaacuggcucaccaucggcaucuccggccccgacaacggggccguggcggugcugaaguacaacggcaucaucaccgacaccaucaagagcuggcgcaacaacauccugcggacgcaggaguccgagugcgccugcgucaacgggagcugcuucaccaucaugaccgacggcccguccgacggccaggccagcuacaagaucuuccgcaucgagaaggggaagaucgugaaguccguggagaugaacgcccccaacuaccacuacgaggagugcucgugcuaccccgacuccagcgagaucacgugcgucugccgggacaacuggcacggcuccaaccgccccugggugagcuucaaccagaaccucgaguaccagaucggguacaucugcuccggcaucuucggggacaacccgcggcccaacgacaagaccggcagcugcggccccguguccucgaacggggccaacggcgucaagggguucuccuucaaguacggcaacgggguguggaucggccgcaccaagagcaucagcucccggaagggcuucgagaugaucugggaccccaacggguggaccggcaccgacaacaacuucagcaucaagcaggacaucguggggaucaacgagugguccggcuacucgggguccuucguccagcacccggagcugacgggccuggacugcauccgccccugcuucuggguggagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 23203 - RNA, 1410 nt, Artificial Sequence
  derived and/or modified CDS sequence (AUadapt) from InfluenzaA__AEI86977__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcacgugcgugaacggcucgugcuucaccgugaugaccgacggcccguccgacgggcaggcgagcuacaagaucuucaagaucgagaagggcaagaucgucaaguccguggagaugaacgcccccaacuaccacuacgaggagugcagcugcuaccccgacuccagcgagaucacgugcgugugccgcgacaacuggcacggguccaaccggcccugggucucguucaaccagaaccucgaguaccagaucggcuacaucugcuccgggaucuucggcgacaacccgcgccccaacgacaagaccggcagcugcgggcccguguccagcaacggcgccaacggggugaagggcuucuccuucaaguacgggaacggcgucuggaucggccggaccaagagcaucagcucccgcaacggguucgagaugaucugggaccccaacggcuggaccgggaccgacaacaacuucucgaucaagcaggacaucgugggcaucaacgagugguccggguacagcggcuccuucgugcagcacccggagcugaccggccuggacugcauccggcccugcuucugggucgagcucauccgcgggcggcccaaggagaacaccaucuggaccagcggcuccagcaucuccuucugcggggugaacagcgacacggucggcugguccuggcccgacggcgccgagcugccguucaccaucgacaaguga

SEQ ID NO: 23204 - RNA, 1410 nt, Artificial Sequence
  derived and/or modified CDS sequence (AUadapt) from InfluenzaA__AEI86997__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaaggagugguccggcuacagcggguccuucgugcagcacccggagcugacgggccuggacugcauccgccccugcuucugggucgagcucauccggggccgccccaaggagaacaccaucuggaccagcggguccaucaucagcuucugcggcgugaacuccgacaccgucggguggagcuggcccgacggcgccgagcugccguucacgaucgacaaguga

SEQ ID NO: 23205 - RNA, 1410 nt, Artificial Sequence
  derived and/or modified CDS sequence (AUadapt) from InfluenzaA__AEI87007__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcuccagccuggagugccgcaccuucuuccugacccagggcgcccuccugaacgacaagcacuccaacgggaccaucaaggaccggagccccuaccgcacgcugauguccugccccaucggcgaggucccgagccccuacaacucgcgguucgaguccguggccuggagcgcguccgccugccacgacgggaucagcuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggccccuccgacggccaggccagcuacaagaucuuccgcaucgagaaggggaagaucgucaaguccguggagaugaacgccccgaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccccggccgaacgacaagaccggcagcugcggccccguguccagcaacggggccaacggcgugaagggguucagcuucaaguacggcaacggggucuggaucggccgcaccaaguccaucucgucccggaacggcuucgagaugaucugggaccccaacggguggaccggcaccgacaacaacuucagcaucaagcaggacaucguggggaucaacgagugguccggcuacagcggguccuucgugcagcaccccgagcugacgggccuggacugcauccgcccgugcuucugggucgagcucauccggggccgccccaaggagaacaccaucuggaccagcggguccagcaucuccuucugcggcgugaacagcgacaccgucgggugguccuggcccgacggcgccgagcugcccuucacgaucgacaaguga

SEQ ID NO: 23206 - RNA, 1410 nt, Artificial Sequence
  derived and/or modified CDS sequence (AUadapt) from InfluenzaA__AEI87017__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagucggucguguccgugaagcuggccgggaacagcucccucugcccggucagcggcugggccaucuacuccaaggacaacagcauccgcaucggcuccaagggggacguguucgugauccgggagcccuucaucucgugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacucgcgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccucggagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagucgaucagcucccggaacggcuucgagaugaucugggaccccaacggguggaccggcaccgacaacaacuucagcaucaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacggggacaccggcggcuggagcuggcccgacggggccgagcugccguucacgaucgacaaguga

SEQ ID NO: 23207 - RNA, 1410 nt, Artificial Sequence; identical to SEQ ID NO: 23111
  derived and/or modified CDS sequence (AUadapt) from InfluenzaA__AEI87027__NA

SEQ ID NO: 23208 - RNA, 1410 nt, Artificial Sequence; identical to SEQ ID NO: 23204
  derived and/or modified CDS sequence (AUadapt) from InfluenzaA__AEI87037__NA

SEQ ID NO: 23209 - RNA, 1410 nt, Artificial Sequence; identical to SEQ ID NO: 23188
  derived and/or modified CDS sequence (AUadapt) from InfluenzaA__AEI87047__NA

SEQ ID NO: 23210 - RNA, 1410 nt, Artificial Sequence
  derived and/or modified CDS sequence (AUadapt) from InfluenzaA__AEI87057__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaaggagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23211 - RNA, 1410 nt, Artificial Sequence; identical to SEQ ID NO: 22659
  derived and/or modified CDS sequence (AUadapt) from InfluenzaA__AEI87067__NA

SEQ ID NO: 23212 - RNA, 1410 nt, Artificial Sequence
  derived and/or modified CDS sequence (AUadapt) from InfluenzaA__AEI87077__NA
augaaccccaaccagaagaucaucaccaucggcucgaucugcaugaccaucgggauggccaaccugauccuccagaucggcaacaucaucuccaucuggaucagccacuccauccaguucgggaaccagaaccagaucggcacgugcaaccagagcgugaucaccuacgagaacaacaccugggucaaccagaccuacgugaacaucuccaacacgaacuucgccgcggggcagagcguggucuccgugaagcuggccggcaacagcucccugugcccggugucgggcugggccaucuacuccaaggacaacagcauccgcaucggguccaagggcgacgucuucgugauccgggagcccuucaucagcugcagcccccucgagugccgcaccuucuuccugacccagggggcccugcucaacgacaagcacuccaacggcaccaucaaggaccggucccccuaccgcacgcugaugagcugcccgaucggggaggugcccucccccuacaacagccgguucgagucggucgccugguccgcgagcgccugccacgacggcaucaacuggcugaccaucggcaucuccgggcccgacaacggcgccguggccgugcucaaguacaacgggaucaucaccgacaccaucaagagcuggcgcaacaacauccugcggacgcaggaguccgagugcgcgugcgucaacggcagcugcuucaccaucaugaccgacggcccguccgacgggcaggccagcuacaagaucuuccgcaucgagaagggcaagaucgugaaguccguggagaugaacgcccccaacuaccacuacgaggagugcucgugcuaccccgacuccagcgagaucacgugcgucugccgggacaacuggcacggguccaaccgccccugggugagcuucaaccagaaccuggaguaccagaucggcuacaucugcuccgggaucuucggcgacaacccgcggcccaacgacaagaccggcagcugcgggcccguguccagcaacggcgccaacggggucaagggcuucuccuucaaguacgggaacggcguguggaucggccgcaccaagagcaucucgucccggaagggguucgagaugaucugggaccccaacggcuggaccgggaccgacaacaacuucagcaucaagcaggacaucgugggcaucaacgagugguccggguacagcggcuccuucguccagcacccggagcucacgggccuggacugcauccgccccugcuucuggguggagcugauccgggggcgccccaaggagaacaccaucuggaccagcggcuccagcaucuccuucugcggggugaacagcgacaccgucggcugguccuggcccgacggcgccgagcucccguucacgaucgacaaguga

SEQ ID NO: 23213 - RNA, 1410 nt, Artificial Sequence
  derived and/or modified CDS sequence (AUadapt) from InfluenzaA__AEI87087__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccgaucucgggcugggccaucuacuccaaggacaacagcauccgcaucggcuccaagggggacgucuucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagucggucgccugguccgcgagcgccugccacgacgggaucaacuggcucaccaucggcaucuccggccccgacaacggggccguggccgugcugaaguacaacggcaucaucaccgacaccaucaagagcuggcgcaacaacauccugcggacgcaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucucgucccggaacggcuucgagaugaucugggaccccaacggguggaccggcaccgacaacaacuucagcaucaagcaggacaucgucgggaucaaggagugguccggcuacagcggguccuucgugcagcacccggagcugacgggccuggacugcauccgccccugcuucuggguggagcucauccggggccgccccaaggagaacaccaucuggaccagcggguccaucaucagcuucugcuccgucaacagcgacaccgugggcugguccuggcccgacggggccgagcugccguucacgaucgacaaguga

SEQ ID NO: 23214 - RNA, 1410 nt, Artificial Sequence; identical to SEQ ID NO: 23185
  derived and/or modified CDS sequence (AUadapt) from InfluenzaA__AEI87097__NA

SEQ ID NO: 23215 - RNA, 1410 nt, Artificial Sequence; identical to SEQ ID NO: 23185
  derived and/or modified CDS sequence (AUadapt) from InfluenzaA__AEI87107__NA

SEQ ID NO: 23216 - RNA, 1413 nt, Artificial Sequence
  derived and/or modified CDS sequence (AUadapt) from InfluenzaA__AEI91968__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagcgcaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccggaucgggagcaagggcgacguguucgugauccgcgagccguucaucuccugcucgcaccucgagugccggacguucuuccugacccagggggcccugcucaacgacaagcacuccaacggcaccgucaaggaccgcagccccuaccgggcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcgcacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgggacaacuggcacgggucgaaccgccccuggguguccuucaaccagaaccuggacuaccagaucggcuacaucugcagcggcgucuucggggacaacccccggcccgaggacggcgagggguccugcaacccggugaccguggacggcgcgaacggggucaagggcuucagcuacaaguacggcaacgggguguggaucggccgcacgaaguccaaccggcugcgcaagggguucgagaugaucugggaccccaacggcuggaccaacaccgacucggacuucuccgugaagcaggacgucguggccaucaccgacuggagcggguacagcggcuccuucgugcagcaccccgagcucacgggccuggacugcaucaagcccugcuucugggucgagcuggugcgggggcucccgcgcgagaacaccaccaucuggaccucgggcuccagcaucuccuucugcggggucaacagcgacacggccaacugguccuggcccgacggcgccgagcugcccuucaccaucgacaaguga

SEQ ID NO: 23217 - RNA, 1410 nt, Artificial Sequence; identical to SEQ ID NO: 16318
  derived and/or modified CDS sequence (AUadapt) from InfluenzaA__AEI91983__NA

SEQ ID NO: 23218 - RNA, 1410 nt, Artificial Sequence; identical to SEQ ID NO: 21626
  derived and/or modified CDS sequence (AUadapt) from InfluenzaA__AEI91984__NA

SEQ ID NO: 23219 - RNA, 1410 nt, Artificial Sequence
  derived and/or modified CDS sequence (AUadapt) from InfluenzaA__AEI92004__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccagcaacggggccuacggcgugaagggguucuccuucaaguacggcaacggggucuggaucggccgcaccaagagcaucucgucccggaacggcuucgagaugaucugggaccccaacggguggaccggcaccgacaacaacuucagcaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23220 - RNA, 1413 nt, Artificial Sequence
  derived and/or modified CDS sequence (AUadapt) from InfluenzaA__AEI92023__NA
augaaccccaaccagaagaucaucaccaucggcucgaucuccaucgccaucgggaucaucagccugaugcuccagaucggcaacaucaucuccaucugggccucgcacuccauccagaccgggagccagaacaacacgggcaucugcaaccagaagaucaucaccuacgagaacuccaccugggugaaccacaccuacgucaacaucaacaacacgaacgugguggcgggggaggacaagaccagcgucacccuggccggcaacuccucgcugugcuccaucagcggcugggccaucuacaccaaggacaacuccauccgcaucgggagcaagggcgacguguucgugauccgggagccguucaucuccugcucgcaccucgagugccgcacguucuuccugacccagggggcccugcucaacgacaagcacuccaacggcaccgucaaggaccggagccccuaccgcgcccugauguccugcccccugggggaggcgcccagcccguacaacucgaaguucgaguccguggccuggagcgccuccgccugccacgacggcaugggcuggcucaccaucgggaucagcggccccgacaacggggcgguggccguccugaaguacaacggcaucaucacgggcaccaucaaguccuggaagaagcagauccugcggacccaggagucggagugcgugugcaugaacggguccugcuucaccaucaugacggacggccccagcaacaaggccgccuccuacaagaucuucaagaucgagaaggggaaggugaccaagagcaucgagcucaacgcccccaacuucuacuacgaggagugcuccugcuacccggacaccggcaucgucaugugcgugugccgcgacaacuggcacgggucgaaccggcccuggguguccuucaaccagaaccuggacuaccagaucggcuacaucugcagcggcgucuucggggacaacccccgccccgaggacggcgagggguccugcaacccggugaccguggacggcacgaacggggucaagggcuucagcuacaaguacggcaacgggguguggaucggccggaccaaguccaaccgccugcggaagggguucgagaugaucugggaccccaacggcuggaccaacaccgacucggacuucuccgugaagcaggacgucguggcgaucacggacuggagcggguacagcggcuccuucgugcagcaccccgagcucaccggccuggacugcauccgccccugcuucugggucgagcuggugcgggggcucccgcgcgagaacaccaccaucuggacgucgggcuccagcaucuccuucugcggggucaacagcgacaccgccaacugguccuggcccgacggcgccgagcugcccuucaccaucgacaaguga

SEQ ID NO: 23221 - RNA, 1410 nt, Artificial Sequence
  derived and/or modified CDS sequence (AUadapt) from InfluenzaA__AEJ10403__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcucgaaccgccccugggucuccuucaaccagaaccucgaguaccagaucggguacaucugcagcggcaucuucggggacaacccgcggcccaacgacaagaccggcuccugcggccccgugagcgccaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgcggagcugccguucacgaucgacaaguga

SEQ ID NO: 23222 - RNA, 1410 nt, Artificial Sequence; identical to SEQ ID NO: 23188
  derived and/or modified CDS sequence (AUadapt) from InfluenzaA__AEJ10413__NA

SEQ ID NO: 23223 - RNA, 1410 nt, Artificial Sequence; identical to SEQ ID NO: 23210
  derived and/or modified CDS sequence (AUadapt) from InfluenzaA__AEJ10423__NA

SEQ ID NO: 23224 - RNA, 1410 nt, Artificial Sequence
  derived and/or modified CDS sequence (AUadapt) from InfluenzaA__AEJ10433__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccggaucggguacaucugcuccggcaucuucggggacaacccgcgccccaacgacaagaccggcagcugcggccccguguccagcaacggggccaacggcgugaagggguucuccuucaaguacggcaacggggucuggaucggccggaccaagagcaucagcucccgcaacggcuucgagaugaucugggaccccaacggguggaccggcaccgacaacaacuucucgaucaagcaggacaucaucgggaucaacgagugguccggcuacagcggguccuucgugcagcacccggagcugacgggccuggacugcauccggcccugcuucuggguggagcucauccgcggccggcccaaggagaacaccaucuggaccagcggguccagcaucuccuucugcggcgucaacagcgggaccgugggcugguccuggcccgacggcgccgagcugccguucacgaucgacaaguga

SEQ ID NO: 23225 - RNA, 1410 nt, Artificial Sequence; identical to SEQ ID NO: 22659
  derived and/or modified CDS sequence (AUadapt) from InfluenzaA__AEJ10443__NA

SEQ ID NO: 23226 - RNA, 1410 nt, Artificial Sequence; identical to SEQ ID NO: 22659
  derived and/or modified CDS sequence (AUadapt) from InfluenzaA__AEJ10453__NA

SEQ ID NO: 23227 - RNA, 1410 nt, Artificial Sequence; identical to SEQ ID NO: 23111
  derived and/or modified CDS sequence (AUadapt) from InfluenzaA__AEJ10463__NA

SEQ ID NO: 23228 - RNA, 1410 nt, Artificial Sequence
  derived and/or modified CDS sequence (AUadapt) from InfluenzaA__AEJ10473__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaagaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaaguucucgaucaagcaggacaucguggggaucaacgagugguccggcuacagcggguccuucgugcagcacccggagcugacgggccugaacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23229 - RNA, 1410 nt, Artificial Sequence; identical to SEQ ID NO: 22659
  derived and/or modified CDS sequence (AUadapt) from InfluenzaA__AEJ10503__NA

SEQ ID NO: 23230 - RNA, 1410 nt, Artificial Sequence; identical to SEQ ID NO: 16318
  derived and/or modified CDS sequence (AUadapt) from InfluenzaA__AEJ10523__NA

SEQ ID NO: 23231 - RNA, 1410 nt, Artificial Sequence; identical to SEQ ID NO: 16318
  derived and/or modified CDS sequence (AUadapt) from InfluenzaA__AEJ10533__NA

SEQ ID NO: 23232 - RNA, 1410 nt, Artificial Sequence; identical to SEQ ID NO: 16318
  derived and/or modified CDS sequence (AUadapt) from InfluenzaA__AEJ10543__NA

SEQ ID NO: 23233 - RNA, 1410 nt, Artificial Sequence; identical to SEQ ID NO: 16318
  derived and/or modified CDS sequence (AUadapt) from InfluenzaA__AEJ10553__NA

SEQ ID NO: 23234 - RNA, 1410 nt, Artificial Sequence; identical to SEQ ID NO: 21415
  derived and/or modified CDS sequence (AUadapt) from InfluenzaA__AEJ10563__NA

SEQ ID NO: 23235 - RNA, 1410 nt, Artificial Sequence; identical to SEQ ID NO: 21415
  derived and/or modified CDS sequence (AUadapt) from InfluenzaA__AEJ10573__NA

SEQ ID NO: 23236 - RNA, 1410 nt, Artificial Sequence; identical to SEQ ID NO: 21415
  derived and/or modified CDS sequence (AUadapt) from InfluenzaA__AEJ10583__NA

SEQ ID NO: 23237 - RNA, 1410 nt, Artificial Sequence
  derived and/or modified CDS sequence (AUadapt) from InfluenzaA__AEJ36305__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaccagcucccggaacggcuucgagaugaucugggaccccaacggguggaccggcacggacaacagcuucuccaucaagcaggacaucguggggaucaacgaguggucgggcuacuccgggagcuucgugcagcacccggagcugaccggccuggacugcauccgccccugcuucugggucgagcucauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 23238 - RNA, 1410 nt, Artificial Sequence; identical to SEQ ID NO: 16318
  derived and/or modified CDS sequence (AUadapt) from InfluenzaA__AEJ37856__NA

SEQ ID NO: 23239 - RNA, 1410 nt, Artificial Sequence; identical to SEQ ID NO: 16318
  derived and/or modified CDS sequence (AUadapt) from InfluenzaA__AEJ37866__NA

SEQ ID NO: 23240 - RNA, 1410 nt, Artificial Sequence; identical to SEQ ID NO: 16318
  derived and/or modified CDS sequence (AUadapt) from InfluenzaA__AEJ37876__NA

SEQ ID NO: 23241 - RNA, 1410 nt, Artificial Sequence; identical to SEQ ID NO: 23188
  derived and/or modified CDS sequence (AUadapt) from InfluenzaA__AEJ37886__NA

SEQ ID NO: 23242 - RNA, 1410 nt, Artificial Sequence
  derived and/or modified CDS sequence (AUadapt) from InfluenzaA__AEJ37896__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggcggaucgucaagagcguggagaugaacgcccccaacuaccacuacgaggagugcuccugcuaccccgacagcuccgagaucacgugcgugugccgcgacaacuggcacggcagcaaccggcccugggucuccuucaaccagaaccucgaguaccagaucggguacaucugcucgggcaucuucggggacaacccgcgccccaacgacaagaccggcuccugcggccccgugagcuccaacggggccaacggcgugaagggguucagcuucaaguacggcaacggggucuggaucggccggaccaagagcaucuccagccgcaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccggcccugcuucugggucgagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 23243 - RNA, 1410 nt, Artificial Sequence; identical to SEQ ID NO: 23188
  derived and/or modified CDS sequence (AUadapt) from InfluenzaA__AEJ37906__NA

SEQ ID NO: 23244 - RNA, 1410 nt, Artificial Sequence; identical to SEQ ID NO: 23188
  derived and/or modified CDS sequence (AUadapt) from InfluenzaA__AEJ37916__NA

SEQ ID NO: 23245 - RNA, 1410 nt, Artificial Sequence; identical to SEQ ID NO: 23188
  derived and/or modified CDS sequence (AUadapt) from InfluenzaA__AEJ37926__NA

SEQ ID NO: 23246 - RNA, 1410 nt, Artificial Sequence; identical to SEQ ID NO: 21042
  derived and/or modified CDS sequence (AUadapt) from InfluenzaA__AEJ37936__NA

SEQ ID NO: 23247 - RNA, 1410 nt, Artificial Sequence; identical to SEQ ID NO: 16318
  derived and/or modified CDS sequence (AUadapt) from InfluenzaA__AEJ37946__NA

SEQ ID NO: 23248 - RNA, 1410 nt, Artificial Sequence; identical to SEQ ID NO: 23188
  derived and/or modified CDS sequence (AUadapt) from InfluenzaA__AEJ37956__NA

SEQ ID NO: 23249 - RNA, 1410 nt, Artificial Sequence; identical to SEQ ID NO: 23188
  derived and/or modified CDS sequence (AUadapt) from InfluenzaA__AEJ37966__NA

SEQ ID NO: 23250 - RNA, 1410 nt, Artificial Sequence; identical to SEQ ID NO: 16318
  derived and/or modified CDS sequence (AUadapt) from InfluenzaA__AEJ37976__NA

SEQ ID NO: 23251 - RNA, 1410 nt, Artificial Sequence; identical to SEQ ID NO: 23188
  derived and/or modified CDS sequence (AUadapt) from InfluenzaA__AEJ37986__NA

SEQ ID NO: 23252 - RNA, 1410 nt, Artificial Sequence; identical to SEQ ID NO: 21812
  derived and/or modified CDS sequence (AUadapt) from InfluenzaA__AEK21372__NA

SEQ ID NO: 23253 - RNA, 1413 nt, Artificial Sequence; identical to SEQ ID NO: 22606
  derived and/or modified CDS sequence (AUadapt) from InfluenzaA__AEK21383__NA

SEQ ID NO: 23254 - RNA, 1410 nt, Artificial Sequence; identical to SEQ ID NO: 21042
  derived and/or modified CDS sequence (AUadapt) from InfluenzaA__AEK21399__NA

SEQ ID NO: 23255 - RNA, 1410 nt, Artificial Sequence; identical to SEQ ID NO: 16318
  derived and/or modified CDS sequence (AUadapt) from InfluenzaA__AEK21409__NA

SEQ ID NO: 23256 - RNA, 1410 nt, Artificial Sequence; identical to SEQ ID NO: 23111
  derived and/or modified CDS sequence (AUadapt) from InfluenzaA__AEK21419__NA

SEQ ID NO: 23257 - RNA, 1410 nt, Artificial Sequence; identical to SEQ ID NO: 23188
  derived and/or modified CDS sequence (AUadapt) from InfluenzaA__AEK21429__NA

SEQ ID NO: 23258 - RNA, 1410 nt, Artificial Sequence
  derived and/or modified CDS sequence (AUadapt) from InfluenzaA__AEK21439__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccucgaacggggccaacggcgugaagggguucuccuucaaguacggcaacggggucuggaucggccgcaccaagagcaucagcucccggaacggcuucgagaugaucugggaccccaacggguggaccggcaccgacaacaacuucagcaagaagcaggacaucguggggaucaacgagugguccggcuacucgggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23259 - RNA, 1410 nt, Artificial Sequence; identical to SEQ ID NO: 23188
  derived and/or modified CDS sequence (AUadapt) from InfluenzaA__AEK21449__NA

SEQ ID NO: 23260 - RNA, 1410 nt, Artificial Sequence; identical to SEQ ID NO: 21042
  derived and/or modified CDS sequence (AUadapt) from InfluenzaA__AEK21459__NA

SEQ ID NO: 23261 - RNA, 1410 nt, Artificial Sequence; identical to SEQ ID NO: 23188
  derived and/or modified CDS sequence (AUadapt) from InfluenzaA__AEK21469__NA

SEQ ID NO: 23262 - RNA, 1410 nt, Artificial Sequence; identical to SEQ ID NO: 23188
  derived and/or modified CDS sequence (AUadapt) from InfluenzaA__AEK21479__NA

SEQ ID NO: 23263 - RNA, 1410 nt, Artificial Sequence; identical to SEQ ID NO: 16318
  derived and/or modified CDS sequence (AUadapt) from InfluenzaA__AEK21489__NA

SEQ ID NO: 23264 - RNA, 1410 nt, Artificial Sequence; identical to SEQ ID NO: 22856
  derived and/or modified CDS sequence (AUadapt) from InfluenzaA__AEK28776__NA

SEQ ID NO: 23265 - RNA, 1410 nt, Artificial Sequence
  derived and/or modified CDS sequence (AUadapt) from InfluenzaA__AEK28787__NA
augaaccccaaccagaagaucaucaccaucggcucggugucccugaccaucagcacgaucugcuucuucaugcagaucgccauccucaucaccaccgucacccugcacuucaagcaguacgaguucuacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucaacgagaccagccggcugggcuacgagaccuucaaggucaucgaggggugguccaaccccaagucgaagcugcagaucaaccgccaggugaucguggaccggggcaaccgcuccggguacagcggcaucuucuccgucgaggggcggucgugcaucaaccgcugcuucuacguggagcucauccggggccgcaaggaggagaccgaggugcuguggaccagcaacuccaucgucguguucugcggcacgagcgggaccuacggcaccggguccuggccggacggcgccgaccugaaccucaugcccaucuga

SEQ ID NO: 23266 - RNA, 1410 nt, Artificial Sequence
  derived and/or modified CDS sequence (AUadapt) from InfluenzaA__AEK28798__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacgggaacgccuccggcaaggccgacaccaagauccucuucaucgaggagggcaagaucgugcacacgagcacccugucgggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugcuccgaccccaacaacgaggagggcgggcacggggucaagggcugggccuucgacgacgggaacgacguguggaugggccgcaccaucagcgagaagucccggcucggcuacgagaccuucaaggucaucgagggguggucgaaccccaaguccaagcugcagaucaaccgccaggugaucguggaccggggcaaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcaccuccgggacguacggcaccgggagcuggccggacggcgccgacaucaaccugaugcccaucuga

SEQ ID NO: 23267 - RNA, 1410 nt, Artificial Sequence
  derived and/or modified CDS sequence (AUadapt) from InfluenzaA__AEK28809__NA
augaaccccaaccagaagaucaucaccaucggcucggugucccugaccaucagcacgaucugcuucuucaugcagaucgccauccucaucaccaccgucaccgugcacuucaagcaguacgaguucaacuccccgcccaacaaccaggugaugcugugcgagcccacgaucaucgagcgcaacaucaccgagaucgucuaccugaccaacaccacgaucgagaaggagaucugccccaagcucgccgaguaccggaacuggucgaagccgcagugcgacaucaccggguucgcgcccuucuccaaggacaacagcauccgccuguccgccggcggggacaucugggugacccgggagcccuacgugucgugcgaccccgacaagugcuaccaguucgcccugggccaggggaccacgcucaacaacguccacuccaacaacaaggugcgcgaccggaccccguaccgcacccugcugaugaacgagcucggcgugcccuuccaccugggcaccaagcaggucugcaucgccuggagcuccucguccugccacgacgggaaggccuggcugcacgugugcaucacgggcgacgacaagaacgcgaccgccagcuucaucuacaacgggcggcucguggacuccgucgugucgugguccaaggagauccugcgcacccaggagagcgagugcgugugcaucaacgggaccugcacggucgugaugaccgacggguccgccucgggcaaggccgacaccaagauccuguucaucgaggagggcaagaucgugcacaccagcacgcucuccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccuggaccccaacaacgaggagggcggccacggggugaagggcugggccuucgacgacgggaacgacgucuggaugggccgcaccaucucggagaagucccggcucggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcugauccgcgggcggaaggaggagaccgagguccucuggaccuccaacagcaucgugguguucugcggcaccuccgggaccuacggcacggggagcuggccggacggcgccgacaucaaccugaugcccaucuga

SEQ ID NO: 23268 - RNA, 1410 nt, Artificial Sequence
  derived and/or modified CDS sequence (AUadapt) from InfluenzaA__AEK28819__NA
augaaccccaaccagaagaucaucaccaucggcucggugucccugaccaucagcacgaucugcuucuucaugcagaucgccauccucaucaccaccgucacccugcacuucaagcaguacgaguucaacuacccgcccaacaaccaggugaugcugugcgagcccacgaucaucgagcgcaacaucaccgagaucguguaccucaccaacaccacgaucgagaaggagaucugccccaagcuggccgaguaccggaacugguccaagccgcagugcgacaucaccggguucgcgcccuucucgaaggacaacuccauccgccugagcgccggcggggacaucugggucacccgggagcccuacguguccugcgaccccgacaagugcuaccaguucgcccucggccaggggaccacgcugaacaacgugcacucgaacaacaccguccgcgagcggaccccguaccgcacccugcucaugaacgagcugggcgugcccuuccaccugggcacgaagcaggucugcaucgccugguccagcuccucgugccacgacgggaaggccuggcuccacgugugcaucaccggcgacgacaagaacgcgaccgccuccuucaucuacaacgggcggcugguggacagcguggucuccuggucgaaggagauccugcgcacccaggaguccgagugcgugugcaucaacggcacgugcaccguggucaugaccgacgggagcgccuccggcaaggccgacaccaagauccucuucaucgaggagggcaagaucgugcacacgucgacccugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccuggugggcgacacgccccggaagaacgacucguccagcuccucgcacugccucgaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcugcagaucaaccgccaggugaucguggaccggggcaaccgcuccggguacagcggcaucuucuccgucgagggcaagucgugcaucaaccggugcuucuacguggagcucauccgcgggcggaaggaggagaccgaggugcuguggaccagcaacuccaucgucguguucugcggcaccagcgggacguacggcaccggguccuggccggacggcgccgacaucaaccugaugcccaucuga

SEQ ID NO: 23269 - RNA, 1410 nt, Artificial Sequence
  derived and/or modified CDS sequence (AUadapt) from InfluenzaA__AEK28830__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaaccuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcggccggaccccguaccgcacccugcucaugaacgagcugggcgugcccuuccaccuggggacgaagcaggucugcaucgccuggagcuccucguccugccacgacggcaaggccuggcuccacgugugcaucaccggggacgacaagaacgcgaccgccagcuucaucuacaacggccggcugguggacuccguggucucgugguccaaggagauccugcgcacccaggagagcgagugcgugugcaucaacgggacgugcaccguggucaugaccgacggcuccgccucgggcaaggccgacaccaagauccucuucaucgaggaggggaagaucgugcacacgagcacccuguccggcucggcgcagcacguggaggagugcuccugcuacccccgguaccccgggguccgcugcgugugccgggacaacuggaagggcagcaaccgcccgaucguggacaucaacaucaaggaccacuccaucgucucguccuacgugugcagcggccuggugggggacacgccccggaagaacgacuccucguccagcucccacugccucgaccccaacaacgaggagggcgggcacggcgucaaggggugggccuucgacgacggcaacgacguguggaugggccgcaccaucucggagaagucccggcugggguacgagaccuucaaggucaucgagggcuggagcaaccccaaguccaagcugcagaucaaccgccaggugaucguggaccgggggaaccgcucgggcuacuccgggaucuucagcgucgagggcaagucgugcaucaaccggugcuucuacguggagcucauccgcggccggaaggaggagaccgaggugcuguggaccuccaacagcaucgucguguucugcgggaccuccggcacguacgggaccggcagcuggccggacggggccgacaucaaccugaugcccaucuga

SEQ ID NO: 23270 - RNA, 1410 nt, Artificial Sequence
  derived and/or modified CDS sequence (AUadapt) from InfluenzaA__AEK28841__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacggugaacaacguccacuccaacaacaccgugcgcggccggaccccguaccgcacccugcugaugaacgagcucggcgugcccuuccaccuggggacgaagcaggucugcaucgccuggagcuccucguccugccacgacggcaaggccuggcugcacgugugcaucaccggggacgacaagaacgcgaccgccagcuucaucuacaacggccggcucguggacuccgucgugucgugguccaaggagauccugcgcacccaggagagcgagugcgugugcaucaacgggacgugcaccgucgugaugaccgacggcuccgccucgggcaaggccgacaccaagauccuguucaucgaggaggggaagaucgugcacacgagcacccucuccggcucggcgcagcacgucgaggagugcuccugcuacccccgguaccccggggugcgcugcgugugccgggacaacuggaagggcagcaaccgcccgaucgucgacaucaacaucaaggaccacuccaucgugucguccuacgugugcagcggccuggucggggacacgccccggaagaacgacuccucguccagcucccacugccuggaccccaacaacgaggagggcgggcacggcgugaaggggugggccuucgacgacggcaacgacgucuggaugggccgcaccaucucggagaagucccggcucggguacgagaccuucaaggugaucgagggcuggagcaaccacaaguccaagcugcagaucaaccgccaggugaucgucgaccgggggaaccgcucgggcuacuccgggaucuucagcguggagggcaagucgugcaucaaccggugcuucuacguggagcugauccgcggccggaaggaggagaccgagguccucuggaccuccaacagcaucgugguguucugcgggaccuccggcacguacgggaccggcagcuggcccgacggggccgaccugaaccugaugccgaucuga

SEQ ID NO: 23271 - RNA, 1410 nt, Artificial Sequence
  derived and/or modified CDS sequence (AUadapt) from InfluenzaA__AEK28852__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaaccggguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggccggacggcgccgacaucaaccugaugcccaucuga

SEQ ID NO: 23272 - RNA, 1410 nt, Artificial Sequence; identical to SEQ ID NO: 20886
  derived and/or modified CDS sequence (AUadapt) from InfluenzaA__AEK28863__NA

SEQ ID NO: 23273 - RNA, 1410 nt, Artificial Sequence
  derived and/or modified CDS sequence (AUadapt) from InfluenzaA__AEK28874__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaagguccgcgaccggaccccguaccgcacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcggcugguggacuccguggucucgugguccaaggagauccugcgcacccaggagagcgagugcgugugcaucaacgggaccugcacgguggucaugaccgacggguccgccucgggcaaggccgacaccaagauccucuucaucgaggagggcaagaucgugcacaccagcacgcuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcggccacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggaccuacggcacggggagcuggcccgacggcgccgaccugaaccucaugccgaucuga

SEQ ID NO: 23274 - RNA, 1410 nt, Artificial Sequence
  derived and/or modified CDS sequence (AUadapt) from InfluenzaA__AEK28885__NA
augaaccccaaccagaagaucaucaccaucggcucggugucccugaccaucagcacgaucugcuucuucaugcagaucgccauccucaucaccaccgucacccugcacuucaagcaguacgaguucaaccugccgcccaacaaccaggugaugcucugcgagcccacgaucaucgagcgcaacaucaccgagaucguguaccugaccaacaccacgaucgagaaggagaucugccccaagcuggccgaguaccggaacugguccaagccgcagugcgacaucaccggguucgcgcccuucucgaaggacaacuccauccgccucagcgccggcggggacaucugggucacccgggagcccuacguguccugcgaccccgacaagugcuaccaguucgcccugggccaggggaccacgcugaacaacgugcacucgaacaacaccguccgcgaccggaccccguaccgcacccuccugaugaacgagcugggcgugcccuuccaccucggcacgaagcaggucugcaucgccugguccagcuccucgugccacgacgggaaggccuggcugcacgugugcaucaccggcgacgacaagaacgcgaccgccuccuucaucuacaacgggcggcugguggacagcguggucuccuggucgaaggagauccuccgcacccaggaguccgagugcgugugcaucaacggcacgugcaccguggucaugaccgacgggagcgccuccggcaaggccgacaccaagauccuguucaucgaggagggcaagaucgugcacacgucgacccugagcggguccgcgcagcacguggaggagugcagcugcuacccccgguaccccggcguccgcugcgugugccgggacaacuggaagggguccaaccgcccgaucguggacaucaacaucaaggaccacucgaucgucuccagcuacgugugcuccggccucgugggcgacacgccccggaagaacgacucguccagcuccucgcacugccuggaccccaacaacgaggagggcgggcacggggucaagggcugggccuucgacgacgggaacgacguguggaugggccgcaccaucuccgagaagucccggcugggcuacgagaccuucaaggucaucgagggguggagcaaccccaagucgaagcuccagaucaaccgccaggugaucguggaccggggcaaccgcuccggguacagcggcaucuucuccgucgagggcaagucgugcaucaaccggugcuucuacguggagcugauccgcgggcggaaggaggagaccgaggugcuguggaccagcaacuccaucgucguguucugcggcaccagcgggacguacggcaccggguccuggccggacggcgccgacaucaaccucaugcccaucuga

SEQ ID NO: 23275 - RNA, 1410 nt, Artificial Sequence; identical to SEQ ID NO: 21011
  derived and/or modified CDS sequence (AUadapt) from InfluenzaA__AEK28896__NA

SEQ ID NO: 23276 - RNA, 1410 nt, Artificial Sequence
  derived and/or modified CDS sequence (AUadapt) from InfluenzaA__AEK28907__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugcccccgccuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaaccugaugcccaucuga

SEQ ID NO: 23277 - RNA, 1410 nt, Artificial Sequence; identical to SEQ ID NO: 19001
  derived and/or modified CDS sequence (AUadapt) from InfluenzaA__AEK28918__NA

SEQ ID NO: 23278 - RNA, 1410 nt, Artificial Sequence; identical to SEQ ID NO: 20307
  derived and/or modified CDS sequence (AUadapt) from InfluenzaA__AEK28929__NA

SEQ ID NO: 23279 - RNA, 1410 nt, Artificial Sequence
  derived and/or modified CDS sequence (AUadapt) from InfluenzaA__AEK28951__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccucgucccacugccucgaccccaacaacgaggagggcgggcacggggucaagggcugggccuucgacgacgggaacgacguguggaugggccgcaccaucagcgagaagucccggucgggcuacgagaccuucaaggucaucgaggggugguccaaccacaagagcaagcugcagaucaaccgccaggugaucguggaccggggcaaccgcuccggguacucgggcaucuucagcgucgaggggaaguccugcaucaaccggugcuucuacguggagcugauccgcggccggaaggaggagaccgaggcccucuggaccucgaacuccaucguggucuucugcggcaccagcgggacguacggcaccggguccuggcccgacggcgccgaccugaaccugaugccgaucuga

SEQ ID NO: 23280 - RNA, 1410 nt, Artificial Sequence
  derived and/or modified CDS sequence (AUadapt) from InfluenzaA__AEK28962__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccccaccaacaccacgaucgagaaggagaucugcccgaagcucgccgaguaccggaacuggagcaagccccagugcgacaucaccggguucgcgcccuucuccaaggacaacucgauccgccuguccgccggcggggacaucugggucacccgggagcccuacgugagcugcgacccggacaagugcuaccaguucgcccugggccaggggaccacgcucaacaacgugcacuccaacaacaccguccgcgaccggacccccuaccgcacccugcugaugaacgagcucggcgugcccuuccaccugggcacgaagcaggucugcaucgccuggucguccagcuccugccacgacgggaaggccuggcugcacgugugcaucaccggcgacgacaagaacgcgaccgccucguucaucuacaacgggcggcucguggacuccguggucagcugguccaaggagauccugcgcacccaggagucggagugcgugugcaucaacggcacgugcaccguggucaugaccgacggguccgccagcggcaaggccgacaccaagauccuguucaucgaggagggcaagaucgugcacacgucgacccucuccgggagcgcgcagcacguggaggagugcuccugcuacccccgguacccgggcguccgcugcgugugccgggacaacuggaaggggucgaaccgccccaucguggacaucaacaucaaggaccacuccaucgucagcuccuacgugugcucgggccuggugggcgacacgccccggaagaacgacuccagcuccucgucccacugccuggaccccaacaacgaggagggcgggcacggggucaagggcugggccuucgacgacgggaacgacguguggaugggccgcaccaucagcgagaagucccggcucggcuacgagaccuucaaggucaucgagggguggucgaacccgaaguccaagcugcagaucaaccgccaggugaucguggaccggggcaaccgcagcggguacuccggcaucuucucggucgagggcaagagcugcaucaaccggugcuucuacguggagcugauccgcgggcggaaggaggagaccgaggugcucuggaccuccaacucgaucgucguguucugcggcaccuccgggacguacggcaccgggagcuggcccgacggcgccgacaucaaccugaugcccaucuga

SEQ ID NO: 23281 - RNA, 1410 nt, Artificial Sequence
  derived and/or modified CDS sequence (AUadapt) from InfluenzaA__AEK28973__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccacaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggcccgacggcgccgaccugaacuucaugccgaucuga

SEQ ID NO: 23282 - RNA, 1410 nt, Artificial Sequence
  derived and/or modified CDS sequence (AUadapt) from InfluenzaA__AEK28984__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcguccgccuguccgccggcggggacaucugggugacccgggagcccuacgugucgugcgaccccgacaagugcuaccaguucgcccucggccaggggaccacgcugaacaacguccacuccaacaacaccgugcgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccgucgugucgugguccaaggagauccugcgcacccaggagagcgagugcgugugcaucaacggcacgugcaccgucgugaugaccgacggguccgccucgggcaaggccgacaccaagauccucuucaucgaggagggcaagaucgugcacacgagcacccuguccgggucggcgcagcacgucgaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggugaucgucgaccggggcaaccgcucgggguacuccggcaucuucagcguggagggcaagucgugcaucaaccggugcuucuacguggagcucauccgcgggcggaaggaggagaccgagguccuguggaccuccaacagcaucgugguguucugcggcaccuccgggacguacggcaccgggagcuggccggacggcgccgacaucaaccugaugcccaucuga

SEQ ID NO: 23283 - RNA, 1410 nt, Artificial Sequence; identical to SEQ ID NO: 23282
  derived and/or modified CDS sequence (AUadapt) from InfluenzaA__AEK28995__NA

SEQ ID NO: 23284 - RNA, 1410 nt, Artificial Sequence; identical to SEQ ID NO: 21920
  derived and/or modified CDS sequence (AUadapt) from InfluenzaA__AEK29006__NA

SEQ ID NO: 23285 - RNA, 1410 nt, Artificial Sequence
  derived and/or modified CDS sequence (AUadapt) from InfluenzaA__AEK29028__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaugaaggaccacuccaucgucagcuccuacgugugcucgggccuggugggcgacacgccccggaagaacgacuccagcuccagcucccacugcuucgaccccaacgacgaggagggcgggcacggggucaagggcugggccuucgacgacgggaacgacguguggaugggccgcaccaucucggagaagucccggcucggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcugauccgcgggcggaaggaggagaccgaggugcucuggaccuccaacagcaucgucguguucugcggcaccuccgggacguacggcaccgggagcuggccggacggcgccgacaucaaccugaugcccaucuga

SEQ ID NO: 23286 - RNA, 1410 nt, Artificial Sequence
  derived and/or modified CDS sequence (AUadapt) from InfluenzaA__AEK29050__NA
augaaccccaaccagaagaucaucaccaucggcucggugucccugaccaucucgacgaucugcuucuucaugcagaucgccauccucaucaccaccgucacccugcacuucaagcaguacgaguucaacccgccgcccaacaaccaggugaugcugugcgagcccacgaucaucgagcgcaacaucaccgagaucguguaccucaccaacaccacgaucgagaaggagaucugccccaagcuggccgaguaccggaacugguccaagccccagugcgacaucaccggguucgcgcccuucagcaaggacaacuccauccgccugucggccggcggggacaucugggucacccgggagcccuacguguccugcgacccggacaagugcuaccaguucgcccucggccaggggaccacgcugaacaacgugcacagcaacaacaccguccgcgaccggacccccuaccgcacccugcucaugaacgagcugggcgugcccuuccaccugggcacgaagcaggucugcaucgccugguccucguccagcugccacgacgggaaggccuggcuccacgugugcaucaccggcgacgacaagaacgcgaccgccuccuucaucuacaacgggcggcugguggacucgguggucuccuggagcaaggagauccugcgcacccaggaguccgagugcgugugcaucaacggcacgugcaccguggucaugaccgacgggucggccuccggcaaggccgacaccaagauccucuucaucgaggagggcaagaucgugcacacgagcacccugucgggguccgcgcagcacguggaggagugcucgugcuacccccgguacccgggcguccgcugcgugugccgggacaacuggaagggguccaaccgccccaucguggacaucaacaucaaggaccacagcaucgucuccucguacgugugcuccggccuggugggcgacacgccccggaagaacgacagcuccucguccagccacugccucgaccccaacaacgaggagggcgggcacggggucaagggcugggccuucgacgacgggaacgacguguggaugggccgcaccaucaacgagaccucccggcugggcuacgagaccuucaaggucaucgagggguggucgaacccgaaguccaagcugcagaucaaccgccaggugaucguggaccggggcaaccgcagcggguacuccggcaucuucucggucgaggggaaguccugcaucaaccggugcuucuacguggagcucauccgcggccggaaggaggagaccgaggugcuguggaccagcaacucgaucgucguguucugcggcacguccgggaccuacggcaccgggagcuggcccgacggcgccgaccugaaccucaugcccaucuga

SEQ ID NO: 23287 - RNA, 1410 nt, Artificial Sequence
  derived and/or modified CDS sequence (AUadapt) from InfluenzaA__AEK29061__NA
augaaccccaaccagaagaucaucaccaucggcucggugucccugaccaucagcacgaucugcuucuucauccagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaucguccgggaccgcaccccguaccggacccugcucaugaacgagcugggcgugcccuuccaccugggcaccaagcaggucugcaucgccuggagcuccucguccugccacgacgggaaggccuggcuccacgugugcaucacgggcgacgacaagaacgcgaccgccagcuucaucuacaacgggcgccugguggacuccguggucucgugguccaaggagauccugcggacccaggagagcgagugcgugugcaucaacgggaccugcacgguggucaugaccgacggguccgccucgggcaaggccgacaccaagauccucuucaucgaggagggcaagaucgugcacaccagcacgcuguccgggagcgcgcagcacguggaggagugcuccugcuacccccgcuaccccggcguccggugcgugugccgcgacaacuggaaggggucgaaccggccgaucguggacaucaacaucaaggaccacuccaucgucagcuccuacgugugcucgggccuggugggcgacacgccccgcaagaacgacuccagcuccucgucccacugccucgaccccaacaacgaggagggcggccacggggucaagggcugggccuucgacgacgggaacgacguguggaugggccggaccaucaacgagaccagccgccugggcuacgagaccuucaaggucaucgaggggugguccaaccccaagucgaagcugcagaucaaccgccaggugaucguggaccggggcaaccgguccggguacagcggcaucuucuccgucgagggcaagucgugcaucaaccgcugcuucuacguggagcucauccgggggcgcaaggaggagaccgaggugcuguggaccagcaacuccaucgucguguucugcggcaccagcgggacguacggcaccggguccuggccggacggcgccgaccugaaccucaugcccaucuga

SEQ ID NO: 23288 - RNA, 1410 nt, Artificial Sequence
  derived and/or modified CDS sequence (AUadapt) from InfluenzaA__AEK29083__NA
augaaccccaaccagaagaucaucaccaucggcucggugucccugaccaucagcacgaucugcuucuucauccagaucgccauccucaucaccaccgucacccugcacuucaagcaguacgaguucaacuccccgcccaacaaccaggugaugcugugcgagcccacgaucaucgagaagaacaucaccgagaucguguaccucaccaacaccacgaucgagaaggagaucugccccaagcuggccgaguaccgcaacuggucgaagccgcagugcgacaucaccggguucgcgcccuucuccaaggacaacagcauccggcuguccgccggcggggacaucugggucacccgcgagcccuacgugucgugcgaccccgacaagugcuaccaguucgcccucggccaggggaccacgcugaacaacgugcacuccaacaacaccguccgggaccgcaccccguaccggacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcgccugguggacuccguggucucgugguccaaggagauccugcggacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgcuaccccggcguccggugcgugugccgcgacaacuggaaggggagcaaccggccgaucguggacaucaacaucaaggaccacuccaucgucucguccuacgugugcagcggccuggugggcgacacgccccgcaagaacgacuccucguccagcucccacugccucgaccccaacaacgaggagggcgggcacggggucaagggcugggccuucgacgacgggaacgacguguggaugggccggaccaucaacgagaccucgcgccugggcuacgagaccuucaaggucaucgaggggugguccaaccccaagagcaagcugcagaucaaccgccaggugaucguggaccggggcaaccgguccggguacucgggcaucuucuccgucgagggcaagagcugcaucaaccgcugcuucuacguggagcucauccgggggcgcaaggaggagaccgaggugcuguggaccucgaacuccaucgucguguucugcggcacgagcgggaccuacggcaccggguccuggccggacggcgccgaccugaaccucaugcccaucuga

SEQ ID NO: 23289 - RNA, 1410 nt, Artificial Sequence; identical to SEQ ID NO: 21812
  derived and/or modified CDS sequence (AUadapt) from InfluenzaA__AEK29094__NA

SEQ ID NO: 23290 - RNA, 1410 nt, Artificial Sequence; identical to SEQ ID NO: 21920
  derived and/or modified CDS sequence (AUadapt) from InfluenzaA__AEK29127__NA

SEQ ID NO: 23291 - RNA, 1410 nt, Artificial Sequence; identical to SEQ ID NO: 21920
  derived and/or modified CDS sequence (AUadapt) from InfluenzaA__AEK29138__NA

SEQ ID NO: 23292 - RNA, 1410 nt, Artificial Sequence
  derived and/or modified CDS sequence (AUadapt) from InfluenzaA__AEK29182__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcuccaggugaaccgccaggugaucgucgaccggggcaaccgcuccggguacucgggcaucuucuccguggagggcaagagcugcaucaaccggugcuucuacguggagcugauccgcgggcggaaggaggagaccgagguccuguggaccucgaacuccaucgugguguucugcggcacgagcgggaccuacggcaccggguccuggccggacggcgccgaccugaaccucaugcccaucuga

SEQ ID NO: 23293 - RNA, 1410 nt, Artificial Sequence
  derived and/or modified CDS sequence (AUadapt) from InfluenzaA__AEK29204__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccaacaccaagguccucuucaucgaggagggcaagaucgugcacacgagcacccuguccgggucggcgcagcacguggaggagugcuccugcuacccccgguaccccggcgugcgcugcgugugccgggacaacuggaaggggagcaaccgcccgaucgucgacaucaacaucaaggaccacuccaucgugucguccuacgugugcagcggccuggucggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggugaucgucgaccggggcaaccgcuccggguacucgggcaucuucuccguggagggcaagagcugcaucaaccggugcuucuacguggagcucauccgcgggcggaaggaggagaccgagguccuguggaccucgaacuccaucgugguguucugcggcacgagcgggaccuacggcaccggguccuggccggacggcgccgaccugaaccucaugcccaucuga

SEQ ID NO: 23294 - RNA, 1410 nt, Artificial Sequence
  derived and/or modified CDS sequence (AUadapt) from InfluenzaA__AEK29215__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcaaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucucgugguccaaggagauccugcgcacccaggagagcgagugcgugugcaucaacggcacgugcaccguggucaugaccgacggguccgccucgggcaaggccgacaccaagauccucuucaucgaggagggcaagaucgugcacacgagcacccuguccgggucggcgcagcacguggaggagugcuccugcuacccccgguaccccggcguccgcugcgugugccgggacaacuggaaggggagcaaccgcccgaucguggacaucaacaucaaggaccacuccaucgucucguccuacgugugcagcggccuggugggcgacacgccccggaagaacgacuccucguccagcucccacugccucgaccccaacaacgaggagggcgggcacggggucaagggcugggccuucgacgacgggaacgacguguggaugggccgcaccaucaacgagaccucgcggcugggcuacgagaccuucaaggucaucgaggggugguccaaccccaagagcaagcugcagaucaaccgccaggugaucguggaccggggcgaccgcuccggguacucgggcaucuucuccgucgagggcaagagcugcaucaaccggugcuucuacguggagcucauccgcgggcggaaggaggagaccgaggugcuguggaccucgaacuccaucgucguguucugcggcacgagcgggaccuacggcaccggguccuggccggacggcgccgaccugaaccucaugcccaucuga

SEQ ID NO: 23295 - RNA, 1410 nt, Artificial Sequence; identical to SEQ ID NO: 23293
  derived and/or modified CDS sequence (AUadapt) from InfluenzaA__AEK29237__NA

SEQ ID NO: 23296 - RNA, 1410 nt, Artificial Sequence; identical to SEQ ID NO: 21920
  derived and/or modified CDS sequence (AUadapt) from InfluenzaA__AEK29248__NA

SEQ ID NO: 23297 - RNA, 1410 nt, Artificial Sequence; identical to SEQ ID NO: 21920
  derived and/or modified CDS sequence (AUadapt) from InfluenzaA__AEK29259__NA

SEQ ID NO: 23298 - RNA, 1410 nt, Artificial Sequence; identical to SEQ ID NO: 21920
  derived and/or modified CDS sequence (AUadapt) from InfluenzaA__AEK29270__NA

SEQ ID NO: 23299 - RNA, 1413 nt, Artificial Sequence
  derived and/or modified CDS sequence (AUadapt) from InfluenzaA__AEK59839__NA
augaaccccaaccagaagaucaucaccaucggcucgaucuccaucgccaucgggaucaucagccugaugcuccagaucggcaacaucaucuccaucugggccucgcacuccauccagaccgggagccagaaccacacgggcaucugcaaccagcgcaucaucaccuacgagaacuccaccugggugaaccacaccuacgucaacaucaacaacacgaacgugguggcggggaaggacaagaccagcgucacccuggccggcaacuccucgcugugcuccaucagcggcugggccaucuacaccaaggacaacuccauccggaucgggucgaagggcgacguguucgugauccgcgagccguucaucuccugcagccaccucgagugccggacguucuuccugacccagggggcccugcucaacgacaagcacuccaacggcaccgucaaggaccgcagccccuaccgggcccugauguccugcccccugggggaggcgcccucgccguacaacagcaaguucgaguccguggccuggagcgccuccgccugccacgacggccucggcuggcugaccaucgggaucucgggccccgacaacggggcgguggccguccugaaguacaacggcaucaucacgggcaccaucaaguccuggaagaagcagauccuccgcacccaggagagcgagugcgugugcaugaacggguccugcuucaccaucaugacggacggccccucgaacggggccgccuccuacaagaucuucaagaucgagaagggcaaggugaccaagagcaucgagcugaacgcccccaacuuccacuacgaggagugcuccugcuacccggacaccgggaucgucaugugcgugugccgggacaacuggcacggcagcaaccgccccuggguguccuucaaccagaaccuggacuaccagaucggcuacaucugcucgggggucuucggcgacaacccccggcccaaggacggggagggcuccugcaacccggugaccguggacggggcggacggcgucaagggcuucagcuacaaguacgacaacgggguguggaucggccgcacgaaguccaaccggcuccgcaagggguucgagaugaucugggaccccaacggcuggaccaacaccgacucggacuucuccgugaagcaggacgucguggccaucaccgacuggagcggguacagcggcuccuucgugcagcaccccgagcugacgggccuggacugcauccggcccugcuucugggucgagcucgugcgcgggcugccgcgggagaacaccaccaucuggaccucgggcuccagcaucuccuucugcggggucaacagcgacacggccaacugguccuggcccgacggcgccgagcugcccuucaccaucgacaaguga

SEQ ID NO: 23300 - RNA, 1410 nt, Artificial Sequence
  derived and/or modified CDS sequence (AUadapt) from InfluenzaA__AEK98375__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccaucgugagcugguccaaggagauccugcgcacccaggagucggagugcgucugcaucaacggcacgugcaccguggugaugaccgacggguccgccagcggcgaggccgacaccaagauccucuucaucgaggagggcaagaucguccacacgucgacccuguccgggagcgcgcagcacguggaggagugcuccugcuacccccgguaccccggcgugcgcugcgucugccgggacaacuggaaggggucgaaccgcccgaucguggacaucaacaucaaggaccacuccaucgugagcuccuacgucugcucgggccuggugggcgacacgccccggaagaacgacuccagcuccucgucccacugccucgaccccaacaacgaggagggcgggcacggggugaagggcugggccuucgacgacgggaacgacgucuggaugggccgcaccaucagcgagaagucccggcugggcuacgagaccuucaaggugaucgagggguggucgaaccccaaguccaagcugcagaccaaccgccaggucaucguggaccggggcaaccgcagcggguacuccggcaucuucucgguggagggcaagagcugcaucaaccggugcuucuacgucgagcucauccgcgggcggaaggaggagaccgaggugcuguggaccuccaacucgaucguggucuucugcggcacguccgggaccuacggcaccgggagcuggccggacggcgccgacaucaaccugaugcccaucuga

SEQ ID NO: 23301 - RNA, 1410 nt, Artificial Sequence; identical to SEQ ID NO: 19001
  derived and/or modified CDS sequence (AUadapt) from InfluenzaA__AEK98377__NA

SEQ ID NO: 23302 - RNA, 1410 nt, Artificial Sequence; identical to SEQ ID NO: 18443
  derived and/or modified CDS sequence (AUadapt) from InfluenzaA__AEK98379__NA

SEQ ID NO: 23303 - RNA, 1410 nt, Artificial Sequence
  derived and/or modified CDS sequence (AUadapt) from InfluenzaA__AEK98381__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacgacaccguccgcgaccggaccccguaccgcacccugcucaugaacgagcugggcgugcccuuccaccugggcacgaagcaggucugcaucgccuggagcuccucguccugccacgacggggaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcgaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccggggcaaccgcucgggguacuccggcaucuucagcguggagggcaagucgugcaucaaccggugcuucuacgucgagcucauccgcgggcggaaggaggagaccgaggugcuguggaccuccaacagcaucguggucuucugcggcaccuccgggacguacggcaccgggagcuggccggacggcgccgacaucaaccugaugcccaucuga

SEQ ID NO: 23304 - RNA, 1410 nt, Artificial Sequence; identical to SEQ ID NO: 18443
  derived and/or modified CDS sequence (AUadapt) from InfluenzaA__AEK98383__NA

SEQ ID NO: 23305 - RNA, 1410 nt, Artificial Sequence; identical to SEQ ID NO: 19001
  derived and/or modified CDS sequence (AUadapt) from InfluenzaA__AEK98385__NA

SEQ ID NO: 23306 - RNA, 1410 nt, Artificial Sequence
  derived and/or modified CDS sequence (AUadapt) from InfluenzaA__AEK98387__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugaucgacuccguggugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggucaucguggaccggggcaaccgcuccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgaccugaaccucaugcccaucuga

SEQ ID NO: 23307 - RNA, 1410 nt, Artificial Sequence; identical to SEQ ID NO: 19001
  derived and/or modified CDS sequence (AUadapt) from InfluenzaA__AEK98389__NA

SEQ ID NO: 23308 - RNA, 1410 nt, Artificial Sequence
  derived and/or modified CDS sequence (AUadapt) from InfluenzaA__AEK98393__NA
augaaccccaaccagaagaucaucaccaucggcucggugucccugaccaucucgacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggagcaagccgcagugcgacaucaccggguucgcgcccuucuccaaggacaacucgauccgccuguccgccggcggggacaucugggucacccgggagcccuacgugagcugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggucguccagcuccugccacgacgggaaggccuggcuccacgugugcaucaccggcgacgacaagaacgcgaccgccucguucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggucggcgcagcacguggaggagugcuccugcuacccccgguaccccggcguccgcugcgugugccgggacaacuggaaggggagcaaccgcccgaucguggacaucaacaucaaggaccacuccaucgccucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucaacgagaccucgcggcugggcuacgagaccuucaaggugaucgaggggugguccaaccccaagagcaagcugcagaucaaccgccaggucaucguggaccggggcaaccgcuccggguacucgggcaucuucuccguggagggcaagagcugcaucaaccggugcuucuacgucgagcucauccgcgggcggaaggaggagaccgaggugcuguggaccucgaacuccaucguggucuucugcggcacgagcgggaccuacggcaccggguccuggccggacggcgccgaccugaaccucaugcccaucuga

SEQ ID NO: 23309 - RNA, 1410 nt, Artificial Sequence; identical to SEQ ID NO: 21920
  derived and/or modified CDS sequence (AUadapt) from InfluenzaA__AEK98395__NA

SEQ ID NO: 23310 - RNA, 1410 nt, Artificial Sequence
  derived and/or modified CDS sequence (AUadapt) from InfluenzaA__AEK98397__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccaacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccguggucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaugaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccggggcaaccgcucgggguacuccggcaucuucagcgucgagggcaagucgugcaucaaccggugcuucuacguggagcucauccgcgggcggaaggaggagaccgaggugcuguggaccuccaacagcaucgucguguucugcggcaccuccgggacguacggcaccgggagcuggccggacggcgccgacaucaacuucaugcccaucuga

SEQ ID NO: 23311 - RNA, 1410 nt, Artificial Sequence; identical to SEQ ID NO: 19001
  derived and/or modified CDS sequence (AUadapt) from InfluenzaA__AEK98399__NA

SEQ ID NO: 23312 - RNA, 1410 nt, Artificial Sequence; identical to SEQ ID NO: 18914
  derived and/or modified CDS sequence (AUadapt) from InfluenzaA__AEK98403__NA

SEQ ID NO: 23313 - RNA, 1410 nt, Artificial Sequence
  derived and/or modified CDS sequence (AUadapt) from InfluenzaA__AEK98405__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgaccggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgugucgugguccaaggagauccugcgcacccaggagagcgagugcgucugcaucaacggcacgugcaccguggugaugaccgacggguccgccucgggcaaggccgacaccaagauccucuucaucgaggagggcaagaucguccacacgagcacccuguccgggucggcgcagcacguggaggagugcuccugcuacccccgguaccccggcgugcgcugcgucugccgggacaacuggaaggggagcaaccgcccgaucguggacaucaacaucaaggaccacuccaucgugucguccuacgucugcagcggccuggugggcgacacgccccggaagaacgacuccucguccagcucccacugccucgaccccaacaacgaggagggcgggcacggggugaagggcugggccuucgacgacgggaacgacgucuggaugggccgcaccaucucggagaagucccggcugggcuacgagaccuucaaggugaucgagggguggagcaaccccaaguccaagcugcagaucaaccgccaggucaucguggaccgggacaaccgcucgggcuacuccgggaucuucagcguggagggcaagucgugcaucaaccggugcuucuacgucgagcucauccgcgggcggaaggaggagaccgaggugcuguggaccuccaacagcaucguggucuucugcggcaccuccggcacguacgggaccggcagcuggccggacggggccgacaucaaccugaugcccaucuga

SEQ ID NO: 23314 - RNA, 1410 nt, Artificial Sequence
  derived and/or modified CDS sequence (AUadapt) from InfluenzaA__AEK98407__NA
augaaccccaaccagaagaucaucaccaucggcucggugucccugaccaucagcacgaucugcuucuucaugcagaucgccauccucaucaccaccgucacccugcacuucaagcaguacgaguucaacuccccgcccaacaaccaggugaugcugugcgagcccacgaucaucgagcgcaacaucaccgagaucguguaccucaccaacaccacgaucgagaaggagaucugccccaagcuggccgaguaccggaacuggucgaagccgcagugcgacaucaccggguucgcgcccuucuccaaggacaacagcauccgccuguccgccggcggggacaucugggucacccgggagcccuacgugucgugcgaccccgacaagugcuaccaguucgcccucggccaggggaccacgcugaacaacgugcacuccaacaacaccguccgcgugcggaccccguaccgcacccugcucaugaacgagcugggcgugcccuuccaccugggcacgaagcaggucugcaucgccuggagcuccucguccugccacgacgggaaggccuggcuccacgugugcaucaccggcgacgacaagaacgcgaccgccagcuucaucuacaacgggcggcugguggacuccaucgucagcugguccaaggagauccugcgcacccaggagucggagugcgugugcaucaacggcacgugcaccguggucaugaccgacggguccgccagcggcaaggccgacaccaagauccucuucaucgaggagggcaagaucgugcacacgucgacccuguccgggagcgcgcagcacguggaggagugcuccugcuacccccgguaccccggcguccgcugcgugugccgggacaacuggaaggggucgaaccgcccgaucguggacaucaacaucaaggaccacuccaucgucagcuccuacgugugcucgggccuggugggcgacacgccccggaagaacgacuccagcuccagcucccacugccucgaccccaacaacgaggagggcgggcacggggucaagggcugggccuucgacgacgggaacgacguguggaugggccgcaccaucucggagaagucccggcugggcuacgagaccuucaaggucaucgagggguggagcaaccccaaguccaagcugcagaucaaccgccaggugaucguggaccgggacaaccgcucgggcuacuccgggaucuucagcgucgagggcaagucgugcaucaaccggugcuucuacguggagcucauccgcgggcggaaggaggagaccgaggugcuguggaccuccaacagcaucgucguguucugcggcaccuccggcacguacgggaccggcagcuggccggacggggccgacaucaaccugaugcccaucuga

SEQ ID NO: 23315 - RNA, 1410 nt, Artificial Sequence; identical to SEQ ID NO: 16729
  derived and/or modified CDS sequence (AUadapt) from InfluenzaA__AEL11690__NA

SEQ ID NO: 23316 - RNA, 1410 nt, Artificial Sequence; identical to SEQ ID NO: 21415
  derived and/or modified CDS sequence (AUadapt) from InfluenzaA__AEL89300__NA

SEQ ID NO: 23317 - RNA, 1410 nt, Artificial Sequence; identical to SEQ ID NO: 21415
  derived and/or modified CDS sequence (AUadapt) from InfluenzaA__AEL89310__NA

SEQ ID NO: 23318 - RNA, 1410 nt, Artificial Sequence; identical to SEQ ID NO: 21415
  derived and/or modified CDS sequence (AUadapt) from InfluenzaA__AEL89320__NA

SEQ ID NO: 23319 - RNA, 1410 nt, Artificial Sequence; identical to SEQ ID NO: 21415
  derived and/or modified CDS sequence (AUadapt) from InfluenzaA__AEL89330__NA

SEQ ID NO: 23320 - RNA, 1410 nt, Artificial Sequence; identical to SEQ ID NO: 21415
  derived and/or modified CDS sequence (AUadapt) from InfluenzaA__AEL89340__NA

SEQ ID NO: 23321 - RNA, 1410 nt, Artificial Sequence; identical to SEQ ID NO: 21415
  derived and/or modified CDS sequence (AUadapt) from InfluenzaA__AEL89350__NA

SEQ ID NO: 23322 - RNA, 1410 nt, Artificial Sequence; identical to SEQ ID NO: 21415
  derived and/or modified CDS sequence (AUadapt) from InfluenzaA__AEL89360__NA

SEQ ID NO: 23323 - RNA, 1410 nt, Artificial Sequence; identical to SEQ ID NO: 21415
  derived and/or modified CDS sequence (AUadapt) from InfluenzaA__AEL89370__NA

SEQ ID NO: 23324 - RNA, 1410 nt, Artificial Sequence; identical to SEQ ID NO: 21415
  derived and/or modified CDS sequence (AUadapt) from InfluenzaA__AEL89394__NA

SEQ ID NO: 23325 - RNA, 1410 nt, Artificial Sequence; identical to SEQ ID NO: 21415
  derived and/or modified CDS sequence (AUadapt) from InfluenzaA__AEL89404__NA

SEQ ID NO: 23326 - RNA, 1410 nt, Artificial Sequence; identical to SEQ ID NO: 21415
  derived and/or modified CDS sequence (AUadapt) from InfluenzaA__AEL89414__NA

SEQ ID NO: 23327 - RNA, 1410 nt, Artificial Sequence; identical to SEQ ID NO: 21415
  derived and/or modified CDS sequence (AUadapt) from InfluenzaA__AEL89424__NA

SEQ ID NO: 23328 - RNA, 1410 nt, Artificial Sequence; identical to SEQ ID NO: 21415
  derived and/or modified CDS sequence (AUadapt) from InfluenzaA__AEL89434__NA

SEQ ID NO: 23329 - RNA, 1410 nt, Artificial Sequence; identical to SEQ ID NO: 21415
  derived and/or modified CDS sequence (AUadapt) from InfluenzaA__AEL89444__NA

SEQ ID NO: 23330 - RNA, 1410 nt, Artificial Sequence; identical to SEQ ID NO: 21415
  derived and/or modified CDS sequence (AUadapt) from InfluenzaA__AEL89454__NA

SEQ ID NO: 23331 - RNA, 1410 nt, Artificial Sequence; identical to SEQ ID NO: 21415
  derived and/or modified CDS sequence (AUadapt) from InfluenzaA__AEL89464__NA

SEQ ID NO: 23332 - RNA, 1410 nt, Artificial Sequence; identical to SEQ ID NO: 21415
  derived and/or modified CDS sequence (AUadapt) from InfluenzaA__AEL89474__NA

SEQ ID NO: 23333 - RNA, 1410 nt, Artificial Sequence
  derived and/or modified CDS sequence (AUadapt) from InfluenzaA__AEL89484__NA
augaaccccaaccagaagaucaucaccaucggcucggugugcaugaccaucgggauggccaaccugaugcuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaucaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23334 - RNA, 1410 nt, Artificial Sequence; identical to SEQ ID NO: 23204
  derived and/or modified CDS sequence (AUadapt) from InfluenzaA__AEL89494__NA

SEQ ID NO: 23335 - RNA, 1410 nt, Artificial Sequence; identical to SEQ ID NO: 23210
  derived and/or modified CDS sequence (AUadapt) from InfluenzaA__AEL89514__NA

SEQ ID NO: 23336 - RNA, 1410 nt, Artificial Sequence; identical to SEQ ID NO: 23188
  derived and/or modified CDS sequence (AUadapt) from InfluenzaA__AEL89524__NA

SEQ ID NO: 23337 - RNA, 1410 nt, Artificial Sequence
  derived and/or modified CDS sequence (AUadapt) from InfluenzaA__AEL89534__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucggcacgugcaaccagagcgucaucaccuacgagaacaacaccugggugaaccagaccuacgugaacaucuccaacacgaacuucgccgcggggcagagcgucguguccgugaagcuggccggcaacucgucccucugcccggucagcggcugggccaucuacuccaaggacaacagcauccgcaucggguccaagggcgacguguucgugauccgggagcccuucaucagcugcucgccccuggagugccgcaccuucuuccugacccagggggcccuccugaacgacaagcacuccaacggcaccaucaaggaccggucccccuaccgcacgcugaugagcugcccgaucggggagguccccucccccuacaacagccgguucgagagcguggccugguccgcgucggccugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgcgugcgugaacggcagcugcuucaccgugaugaccgacggcccguccgacgggcaggccagcuacaagaucuuccgcaucgagaagggcaagaucgucaaguccguggagaucaacgcccccaacuaccacuacgaggagugcucgugcuaccccgacuccagcgagaucacgugcgugugccgggacaacuggcacggguccaaccgccccugggucagcuucaaccagaaccucgaguaccagaucggcuacaucugcuccgggaucuucggcgacaacccgcggcccaacgacaagaccggcagcugcgggcccguguccucgaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucagcaagaagcaggacaucgugggcaucaacgagugguccggguacucgggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 23338 - RNA, 1410 nt, Artificial Sequence; identical to SEQ ID NO: 23210
  derived and/or modified CDS sequence (AUadapt) from InfluenzaA__AEL89544__NA

SEQ ID NO: 23339 - RNA, 1410 nt, Artificial Sequence; identical to SEQ ID NO: 23210
  derived and/or modified CDS sequence (AUadapt) from InfluenzaA__AEL89554__NA

SEQ ID NO: 23340 - RNA, 1410 nt, Artificial Sequence
  derived and/or modified CDS sequence (AUadapt) from InfluenzaA__AEL89564__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucgugaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacucgaacgggaccaucaaggaccggucccccuaccgcacgcugaugagcugcccgaucggcgaggugcccucccccuacaacagccgguucgagagcguggccugguccgcgagcgccugccacgacgggaucuccuggcucaccaucggcaucucgggccccgacaacggggccgucgccgugcugaaguacaacggcaucaucaccgacaccaucaaguccuggcgcaacaacauccugcggacgcaggagagcgagugcgcgugcgugaacggguccugcuucaccgucaugaccgacggcccgagcgacggccaggccuccuacaagaucuuccgcaucgagaaggggaagaucgugaaguccguggagaugaacgcccccaacuaccacuacgaggagugcuccugcuaccccgacagcuccgagaucacgugcgucugccgggacaacuggcacggcagcaaccgccccuggguguccuucaaccagaaccucgaguaccagaucggguacaucugcucgggcaucuucggggacaacccgcggcccaacgacaagaccggcuccugcggccccgugagcuccaacggggccaacggcgucaagggguucagcuucaaguacggcaacgggguguggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucguccagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 23341 - RNA, 1410 nt, Artificial Sequence; identical to SEQ ID NO: 23210
  derived and/or modified CDS sequence (AUadapt) from InfluenzaA__AEL89574__NA

SEQ ID NO: 23342 - RNA, 1410 nt, Artificial Sequence; identical to SEQ ID NO: 23210
  derived and/or modified CDS sequence (AUadapt) from InfluenzaA__AEL89584__NA

SEQ ID NO: 23343 - RNA, 1410 nt, Artificial Sequence; identical to SEQ ID NO: 20157
  derived and/or modified CDS sequence (AUadapt) from InfluenzaA__AEL89604__NA

SEQ ID NO: 23344 - RNA, 1410 nt, Artificial Sequence; identical to SEQ ID NO: 22659
  derived and/or modified CDS sequence (AUadapt) from InfluenzaA__AEL89624__NA

SEQ ID NO: 23345 - RNA, 1410 nt, Artificial Sequence
  derived and/or modified CDS sequence (AUadapt) from InfluenzaA__AEL89634__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugucguccaacggggccaacggcgugaagggguucagcuacaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23346 - RNA, 1410 nt, Artificial Sequence; identical to SEQ ID NO: 21415
  derived and/or modified CDS sequence (AUadapt) from InfluenzaA__AEL89644__NA

SEQ ID NO: 23347 - RNA, 1410 nt, Artificial Sequence; identical to SEQ ID NO: 23111
  derived and/or modified CDS sequence (AUadapt) from InfluenzaA__AEL89654__NA

SEQ ID NO: 23348 - RNA, 1410 nt, Artificial Sequence; identical to SEQ ID NO: 22659
  derived and/or modified CDS sequence (AUadapt) from InfluenzaA__AEL89664__NA

SEQ ID NO: 23349 - RNA, 1410 nt, Artificial Sequence; identical to SEQ ID NO: 22659
  derived and/or modified CDS sequence (AUadapt) from InfluenzaA__AEL89674__NA

SEQ ID NO: 23350 - RNA, 1410 nt, Artificial Sequence; identical to SEQ ID NO: 22659
  derived and/or modified CDS sequence (AUadapt) from InfluenzaA__AEL89694__NA

SEQ ID NO: 23351 - RNA, 1410 nt, Artificial Sequence
  derived and/or modified CDS sequence (AUadapt) from InfluenzaA__AEL89704__NA
augaaccccaaccagaagaucaucaccaucggcucggugugcaugaccaucgggauggccaaccugauccuccagaucggcaacaucauccugaucuggaucucccacagcauccagcuggggaaccagaaccagaucgagacgugcaaccaguccgucaucaccuacgagaacaacaccugggugaaccagaccuacgugaacaucagcaacacgaacuucgccgcgggccaguccgucgugagcgugaagcucgccgggaacuccucgcugugcccggucuccggcugggccaucuacagcaaggacaacuccauccgcaucggcagcaagggggacguguucgugauccgggagcccuucaucuccugcagcccccuggagugccgcaccuucuuccucacccagggcgcccugcugaacgacaagcacuccaacgggaccaucaaggaccggagccccuaccgcacgcucauguccugcccgaucggcgagguccccucgcccuacaacucccgguucgagagcguggccuggagcgcguccgccugccacgacgggaucaacuggcugaccaucggcaucagcggccccgacaacggggccguggccguccugaaguacaacggcaucaucaccgacaccaucaaguccuggcgcaacaacauccuccggacgcaggagucggagugcgcgugcgugaacggguccugcuucaccgugaugaccgacggcccgaacgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucagcuucaaccagaaccuggaguaccagaucggguacaucugcuccggcaucuucggggacaacccgcggcccaacgacaagaccggcucgugcggccccguguccagcaacggggccaacggcgugaagggguucuccuucaaguacggcaacggggucuggaucggccgcaccaagagcaucuccagccggaacggcuucgagaugaucugggaccccaacggguggaccggcaccgacaacaacuucucggugaagcaggacaucaucgggaucaacgagugguccggcuacagcggguccuucgugcagcacccggagcugacgggccucgacugcauccgccccugcuucugggucgagcugauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23352 - RNA, 1410 nt, Artificial Sequence; identical to SEQ ID NO: 23351
  derived and/or modified CDS sequence (AUadapt) from InfluenzaA__AEL89714__NA

SEQ ID NO: 23353 - RNA, 1410 nt, Artificial Sequence; identical to SEQ ID NO: 22659
  derived and/or modified CDS sequence (AUadapt) from InfluenzaA__AEL89744__NA

SEQ ID NO: 23354 - RNA, 1410 nt, Artificial Sequence
  derived and/or modified CDS sequence (AUadapt) from InfluenzaA__AEL89754__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucaucaucgacaaguga

SEQ ID NO: 23355 - RNA, 1410 nt, Artificial Sequence; identical to SEQ ID NO: 21415
  derived and/or modified CDS sequence (AUadapt) from InfluenzaA__AEL89774__NA

SEQ ID NO: 23356 - RNA, 1410 nt, Artificial Sequence
  derived and/or modified CDS sequence (AUadapt) from InfluenzaA__AEL89784__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagccugcggaacggcuucgagaugaucugggaccccaacggguggaccggcaccgacaacaacuucuccgugaagcaggacaucaucgggaucaacgaguggucgggcuacuccgggagcuucgugcagcacccggagcugacgggccucgacugcauccgccccugcuucugggucgagcugauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23357 - RNA, 1410 nt, Artificial Sequence
  derived and/or modified CDS sequence (AUadapt) from InfluenzaA__AEL89794__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggucgcccuaccgcacgcugauguccugcccgaucggcgagguccccagccccuacaacagccgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccaucaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcucgggcaucuucggggacaacccgcggcccaacgacaagaccggcuccugcggccccgucagcuccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacgccgugggguggagcuggcccgacggcgcggagcugccguucaccaucgacaaguga

SEQ ID NO: 23358 - RNA, 1410 nt, Artificial Sequence; identical to SEQ ID NO: 23111
  derived and/or modified CDS sequence (AUadapt) from InfluenzaA__AEL89804__NA

SEQ ID NO: 23359 - RNA, 1410 nt, Artificial Sequence
  derived and/or modified CDS sequence (AUadapt) from InfluenzaA__AEL89815__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucggugaagcaggacaucaucgggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23360 - RNA, 1410 nt, Artificial Sequence
  derived and/or modified CDS sequence (AUadapt) from InfluenzaA__AEL89825__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcgccaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucucguucaaguacggcaacggggucuggaucggccgcaccaaguccaucagcagccggaacggcuucgagaugaucugggaccccaacggguggaccggcaccgacaacaacuucuccaucaagcaggacaucguggggaucaacgaguggagcggcuacuccgggucguucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgcggagcugccguucacgaucgacaaguga

SEQ ID NO: 23361 - RNA, 1410 nt, Artificial Sequence
  derived and/or modified CDS sequence (AUadapt) from InfluenzaA__AEL89835__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugagcgugaagcuggccgggaacuccucgcucugcccggucuccggcugggccaucuacagcaaggacaacuccauccgcaucggcagcaagggggacguguucgugauccgggagcccuucaucuccugcagcccccuggagugccgcaccuucuuccugacccagggcgcccuccugaacgacaagcacuccaacgggaccaucaaggaccggagccccuaccgcacgcugauguccugcccgaucggcgagguccccagccccuacaacucgcgguucgaguccguggccuggagcgcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgugugcgugaacggguccugcuucaccaucaugaccgacggcccgagcgacggccaggcguccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaagagcaucuccucgcggaagggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23362 - RNA, 1410 nt, Artificial Sequence
  derived and/or modified CDS sequence (AUadapt) from InfluenzaA__AEL89845__NA
augaaccccaaccagaagaucaucaccaucggcucggugugcaugaccaucgggauggccaaccugauccuccagaucggcaacaucaucuccaucuggaucagccacuccauccagcuggggaacaagaaccagaucgagacgugcaaccagagcgucaucaccuacgagaacaacaccugggugaaccagaccuacgugaacaucuccaacacgaacuucgccaccggccagagcgucguguccgugaagcuggcggggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggacgaucaaggaccggucccccuaccgcacccugaugagcugcccgaucggcgaggcccccucccccuacaacagccgguucgagagcgucgccugguccgcgucggccugccacgacgggaucaacuggcucaccaucggcaucuccggccccgacaacggggccguggccgugcugaaguacaacggcaucaucaccgacacgaucaagagcuggcgcaacaacauccugcggacccaggaguccgagugcgcgugcgucaacgggagcugcuucaccgugaugaccgacggcccguccgacggccaggccagcuacaagaucuuccgcaucgagaaggggaagaucgugaaguccgucgagaugaacgcccccaacuaccacuacgaggagugcucgugcuaccccgacuccagcgagaucacgugcgugugccgggacaacuggcacggcuccaaccgccccugggugagcuucaaccagaaccucgaguaccagaucggguacaucugcuccggcaucuucggggacaacccgcggcccaacgacaagaagggcagcugcggccccgucuccucgaacggggccaacggcgugaagggguucuccuucaaguacggcaacgggguguggaucggccgcaccaagagcaucagcucccggaacggcuucgagaugaucugggaccccaacggguggaccggcaccgacaacaacuucagcaucaagcaggacaucgucgggaucaacgagugguccggcuacucgggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23363 - RNA, 1410 nt, Artificial Sequence; identical to SEQ ID NO: 23360
  derived and/or modified CDS sequence (AUadapt) from InfluenzaA__AEL89855__NA

SEQ ID NO: 23364 - RNA, 1410 nt, Artificial Sequence; identical to SEQ ID NO: 22659
  derived and/or modified CDS sequence (AUadapt) from InfluenzaA__AEL93581__NA

SEQ ID NO: 23365 - RNA, 1410 nt, Artificial Sequence
  derived and/or modified CDS sequence (AUadapt) from InfluenzaA__AEL93591__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaaccuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggaccggcaccgacaacaacuucucgaucaagcaggacaucgucgggaucaacgagugguccggcuacagcggguccuucgugcagcacccggagcugacgggccuggacugcauccgccccugcuucuggguggagcucauccggggccgccccaaggagaacaccaucuggaccagcggguccagcaucuccuucugcggcgucaacagcgacaccguggggugguccuggcccgacggcgccgagcugccguucacgaucgacaaguga

SEQ ID NO: 23366 - RNA, 1410 nt, Artificial Sequence; identical to SEQ ID NO: 23111
  derived and/or modified CDS sequence (AUadapt) from InfluenzaA__AEL93601__NA

SEQ ID NO: 23367 - RNA, 1410 nt, Artificial Sequence; identical to SEQ ID NO: 22659
  derived and/or modified CDS sequence (AUadapt) from InfluenzaA__AEL93611__NA

SEQ ID NO: 23368 - RNA, 1410 nt, Artificial Sequence; identical to SEQ ID NO: 22659
  derived and/or modified CDS sequence (AUadapt) from InfluenzaA__AEL93621__NA

SEQ ID NO: 23369 - RNA, 1410 nt, Artificial Sequence; identical to SEQ ID NO: 22659
  derived and/or modified CDS sequence (AUadapt) from InfluenzaA__AEL93631__NA

SEQ ID NO: 23370 - RNA, 1410 nt, Artificial Sequence
  derived and/or modified CDS sequence (AUadapt) from InfluenzaA__AEL93641__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucuccuggcucaccaucggcaucagcggccccgacaacggggccguggccguccugaaguacaacggcaucaucaccgacaccaucaaguccuggcgcaacaacauccugcggacgcaggagucggagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacagcuccgagaucacgugcgugugccgggacaacuggcacggcagcaaccgccccugggucuccuucaaccacaaccucgaguaccagaucggguacaucugcucgggcaucuucggggacaacccgcggcccaacgacaagaccggcuccugcggccccgugagcuccaacggggccaacggcgugaagggguucagcuucaaguacggcaacggggucuggaucggccgcaccaagagcaucuccagccggaacggcuucgagaugaucugggaccccaacggguggaccggcaccgacaacaacuucuccaucaagcaggacaucguggggaucaacgaguggucgggcuacuccgggagcuucgugcagcacccggagcugacgggccuggacugcauccgccccugcuucugggucgagcucauccggggccagcccaaggagaacaccaucuggaccuccgggagcuccaucagcuucugcggcgugaacuccgacaccgucggguggagcuggcccgacggcgccgagcugccguucacgaucgacaaguga

SEQ ID NO: 23371 - RNA, 1410 nt, Artificial Sequence; identical to SEQ ID NO: 23210
  derived and/or modified CDS sequence (AUadapt) from InfluenzaA__AEL94890__NA

SEQ ID NO: 23372 - RNA, 1410 nt, Artificial Sequence
  derived and/or modified CDS sequence (AUadapt) from InfluenzaA__AEL95429__NA
augaaccccaaccagaagaucaucaccaucggcucggugugcaugaccaucgggauggccaaccugauccuccagaucggcaacaucaucuccaucuggaucagccacuccauccagcuggggaaccagagccagaucgagacgugcaaccaguccgucaucaccuacgagaacaacaccugggugaaccagaccuacgugaacaucagcaacacgaacuucgccgcgggccaguccgucgugucggugaagcuggccgggaacuccagccucugcccggucuccggcugggccaucuacagcaaggacaacuccauccgcaucggcagcaagggggacguguucgugauccgggagcccuucaucuccugcucgccccuggagugccgcaccuucuuccugacccagggcgcccuccugaacgacaagcacuccaacgggaccaucaaggaccggagcccccaccgcacgcugauguccugcccgaucggcgagguccccagccccuacaacagccgguucgaguccguggccuggucggcguccgccugccacgacgggaucaacuggcucaccaucggcaucagcggccccgacaacggggccguggccguccugaaguacaacggcaucaucaccgacaccaucaaguccuggcgcaacaacauccugcggacgcaggagagcgagugcgcgugcgugaacggguccugcuucaccaucaugaccgacggcccgagcgacggccaggccuccuacaagaucuuccgcaucgagaaggggaagaucgucaagucgguggagaugaacgcccccaacuaccacuacgaggagugcuccugcuaccccgacagcuccgagaucacgugcgugugccgggacaacuggcacggcagcaaccgccccuggguguccuucaaccagaaccucgaguaccagaucggguacaucugcagcggcaucuucggggacaacccgcggcccaacgacaagaccggcuccugcggccccgucucguccaacggggccaacggcgugaagggguucagcuucaaguacggcaacgggguguggaucggccgcaccaagagcaucuccagccggaagggcuucgagaugaucugggaccccaacggguggaccggcaccgacaacaacuucuccaucaagcaggacaucgucgggaucaacgaguggucgggcuacuccgggagcuucgugcagcacccggagcugacgggccuggacugcauccgccccugcuucuggguggagcucauccggggccgccccaaggagaacaccaucuggaccuccgggagcuccaucagcuucugcggcgucaacuccgacaccgugggguggagcuggcccgacggcgccgagcugccguucacgaucgacaaguga

SEQ ID NO: 23373 - RNA, 1410 nt, Artificial Sequence
  derived and/or modified CDS sequence (AUadapt) from InfluenzaA__AEL97634__NA
augaaccccaaccagaagaucaucaccaucggcucggugugcaugaccaucgggauggccaaccugauccuccagaucggcaacaucaucuccaucugggucagccacuccauccagcuggggaaccagaaccagaucgagacgugcaaccagagcgugaucaccuacgagaacaacaccugggugaaccagaccuacgucaacaucuccaacacgaacuucgccgcgggccagagcgugguguccgucaagcuggccgggaacucgucccucugcccggugagcggcugggccaucuacuccaaggacaacagcauccgcaucggcuccaagggggacguguucgucauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgaggugcccucccccuacaacagccgguucgagagcguggccugguccgcgagcgccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggucgugcuucaccgucaugaccgacggcccguccgacggccaggccagcuacaagaucuuccgcaucgagaaggggaagaucgugaaguccguggagaugaacgcccccaacuaccacuacgaggagugcagcugcuaccccgacuccagcgagaucacgugcgucugccgggacaacuggcacggcuccaaccgccccugggugucguucaaccagaaccucgaguaccagaucggguacaucugcuccggcaucuucggggacaacccgcggcccaacgacaagaccggcagcugcggccccguguccagcaacggggccaacggcgucaagggguucuccuucaaguacggcaacgggguguggaucggccgcaccaagagcaucagcucccggaacggcuucgagaugaucugggaccccaacggguggaccggcaccgacaacaacuucucgaucaagcaggacaucgugggggucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccguggggugguccuggcccgacggcgccgagcugccguucacgaucgacaaguga

SEQ ID NO: 23374 - RNA, 1410 nt, Artificial Sequence; identical to SEQ ID NO: 16318
  derived and/or modified CDS sequence (AUadapt) from InfluenzaA__AEL99667__NA

SEQ ID NO: 23375 - RNA, 1410 nt, Artificial Sequence; identical to SEQ ID NO: 16318
  derived and/or modified CDS sequence (AUadapt) from InfluenzaA__AEL99677__NA

SEQ ID NO: 23376 - RNA, 1410 nt, Artificial Sequence; identical to SEQ ID NO: 18178
  derived and/or modified CDS sequence (AUadapt) from InfluenzaA__AEM53471__NA

SEQ ID NO: 23377 - RNA, 1413 nt, Artificial Sequence; identical to SEQ ID NO: 18855
  derived and/or modified CDS sequence (AUadapt) from InfluenzaA__AEM60040__NA

SEQ ID NO: 23378 - RNA, 1413 nt, Artificial Sequence; identical to SEQ ID NO: 18445
  derived and/or modified CDS sequence (AUadapt) from InfluenzaA__AEM60061__NA

SEQ ID NO: 23379 - RNA, 1410 nt, Artificial Sequence
  derived and/or modified CDS sequence (AUadapt) from InfluenzaA__AEM60072__NA
augaaccccaaccagaagaucaucaccaucggcucggugucccugaccaucgccacgaucugcuuccucaugcagaucgccauccuggucaccaccgugacccugcacuucaagcaguacgagugcucguccccgcccaacaaccaggugaugcccugcgagcccacgaucaucgagcgcaacaucaccgagaucgucuaccucaccaacaccacgaucgagaaggagaucugcccgaagcugguggaguaccggaacuggagcaagccccagugcaagaucaccggguucgcgcccuucuccaaggacaacucgauccgccuguccgccggcggggacaucugggugacccgggagcccuacgucagcugcgacccgggcaagugcuaccaguucgcccucgggcagggcaccacgcugaacaaccgccacuccaacgacaccgugcacgaccggacccccuaccgcacccugcucaugaacgagcugggcgugcccuuccaccuggggacgaagcaggucugcaucgccuggucguccagcuccugccacgacggcaaggccuggcuccacgugugcgugaccgggcacgacgagaacgcgaccgccucguucaucuacgacggccggcuggucgacuccaucgggucgugguccaagaacauccugcgcacccaggagagcgagugcgugugcaucaacggcacgugcaccguggucaugaccgacggcuccgccucggagcgggccgacaccaagauccucuucaucgaggaggggaagaucgugcacaucagcccccuguccggcucggcgcagcacguggaggagugcuccugcuacccgcgcuaccccgggguccggugcgugugccgcgacaacuggaagggcagcaaccggcccaucguggacaucaacgucaaggacuacuccaucgugucguccuacgugugcagcggccuggucggggacacgccccgcaagaacgaccgguccucguccucguacugccgcaacccgaacaacgagaagggcucccacggggugaagggcugggccuucgacgacgggaacgacgucuggaugggccggaccaucggcgaggagcuccgcagcggguacgagaccuucaaggugaucggcgggugguccacccccaacucgaagcugcagaucaaccgccaggugaucgucgacuccggcaaccggagcggguacuccggcaucuucucgguggagggcaagagcugcaucaaccggugcuucuacguggagcugauccgcgggcgcgagcaggagacgcgggucugguggaccuccaacucgaucgugguguucugcggcaccuccgggaccuacggcacggggagcuggcccgacggcgccgacaucaaccucaugcccaucuga

SEQ ID NO: 23380 - RNA, 1410 nt, Artificial Sequence; identical to SEQ ID NO: 16318
  derived and/or modified CDS sequence (AUadapt) from InfluenzaA__AEM62774__NA

SEQ ID NO: 23381 - RNA, 1410 nt, Artificial Sequence; identical to SEQ ID NO: 16318
  derived and/or modified CDS sequence (AUadapt) from InfluenzaA__AEM62783__NA

SEQ ID NO: 23382 - RNA, 1410 nt, Artificial Sequence
  derived and/or modified CDS sequence (AUadapt) from InfluenzaA__AEM62792__NA
augaaccccaaccagaagaucaucaccaucggcucggugugcaugaccaucgggauggccaaccugauccuccagaucggcaacaucaucuccaucuggaucagccacuccauccagcuggggagccagaaccagaucgagacgugcaaccaguccgucaucaccuacgagaacaacaccugggugaaccagaccuacgugaacaucagcaacacgaacuucgccgcgggccaguccgucaucucggugcgccuggccgggaacuccagccucugcccgguguccggcugggccaucuacagcaaggacaacuccauccggaucggcagcaagggggacgucuucgugauccgcgagcccuucaucuccugcagcccccuggagugccggaccuucuuccugacccagggcgcccuccugaacgacaagcacuccaacgggaccaucaaggaccgcucgcccuaccggacgcugauguccugcccgaucggcgaggugcccagccccuacaacagccgcuucgaguccgucgccuggagcgcguccgccugccacgacgggaucaacuggcucaccaucggcaucagcggccccgacaacggggccguggccgugcugaaguacaacggcaucaucaccgacaccaucaaguccuggcggaacaacauccugcgcacgcaggagucggagugcgcgugcgucaacggguccugcuucaccgugaugaccgacggcccgagcgacggccaggccuccuacaagaucuuccggaucgagaaggggaagaucgucaagagcguggagaugaacgcccccaacuaccacuacgaggagugcuccugcuaccccgacagcuccgagaucacgugcgugugccgcgacaacuggcacggcagcaaccggcccuggguguccuucaaccagaaccucgaguaccagaucggguacaucugcucgggcaucuucggggacaacccgcgccccaacgacaagaccggcuccugcggccccgucagcuccaacggggccaacggcgugaagggguucagcuucaaguacggcaacgggguguggaucggccggaccaagagcaucuccagccgcaacggcuucgagaugaucugggaccccaacggguggaccggcaccgacaacaacuucuccaucaagcaggacaucaucgggaucaacgaguggucgggcuacuccgggagcuucguccagcacccggagcugacgggccuggacugcauccggcccugcuucuggguggagcucauccgcggccggcccaaggagaacaccaucuggaccuccgggagcuccaucagcuucugcggcgugaacuccgacaccgucggguggagcuggcccgacggcgccgagcugccguucacgaucgacaaguga

SEQ ID NO: 23383 - RNA, 1410 nt, Artificial Sequence; identical to SEQ ID NO: 16318
  derived and/or modified CDS sequence (AUadapt) from InfluenzaA__AEM62801__NA

SEQ ID NO: 23384 - RNA, 1410 nt, Artificial Sequence
  derived and/or modified CDS sequence (AUadapt) from InfluenzaA__AEM62810__NA
augaaccccaaccagaagaucaucaccaucggcucggugugcaugaccaucgggaugggcaaccugauccuccagaucgggaacaucaucuccaucuggaucagccacuccauccagcugggcaaccagaaccagaucgagacgugcaaccagagcgucaucaccuacgagaacaacaccugggugaaccagaccuacgugaacaucuccaacacgaacuucgccgccgggcagagcgucguguccgugaagcuggcgggcaacucgucccucugcccggucagcggcugggccaucuacuccaaggacaacagcauccgcaucggguccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgccagcgcgugccacgacggcaucaacuggcucaccaucggcaucuccgggcccgacaacggcgccguggccguccugaaguacaacgggaucaucaccgacaccaucaagagcuggcgcaacaacauccugcggacgcaggaguccgagugcgccugcgugaacggcucgugcuucaccgugaugaccgacggcccguccgacgggcaggcgagcuacaagaucuuccgcaucgagaagggcaagaucgucaaguccguggagaugaacgcccccaacuaccacuacgaggagugcagcugcuaccccgacuccagcgagaucacgugcgugugccgggacaacuggcacggguccaaccgccccugggucucguucaaccagaaccucgaguaccagaucggcuacaucugcuccgggaucuucggcgacaacccgcggcccaacgacaagaccggcagcugcgggcccguguccagcaacggcgccaacggggugaagggcuucuccuucaaguacgggaacggcgucuggaucggccgcaccaagagcaucagcucccggaacggguucgagaugaucugggaccccaacggcuggaccgggaccgacaacaacuucucgaucaagcaggacaucgugggcaucaacgagugguccggguacagcggcuccuucgugcagcacccggagcugacgggccuggacugcauccgccccugcuucugggucgagcucauccgggggcgccccaaggagaacaccaucuggaccagcggcuccagcaucuccuucugcggggugaacagcgacaccgucggcugguccuggcccgacggcgccgagcugccguucacgaucgacaaguga

SEQ ID NO: 23385 - RNA, 1410 nt, Artificial Sequence
  derived and/or modified CDS sequence (AUadapt) from InfluenzaA__AEM62819__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacgacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccgugaugaccgacggcccguccgacggccaggccagcuacaagaucuuccgcaucgagaaggggaagaucgucaaguccguggagaugaacgcccccaacuaccacuacgaggagugcagcugcuaccccgacuccagcgagaucacgugcgugugccgggacaacuggcacggcuccaaccgccccugggucucguucaaccagaaccucgaguaccagaucggguacaucugcuccggcaucuucggggacaacccgcggcccaacgacaagaccggcagcugcggccccguguccagcaacggggccaacggcgugaagggguucuccuucaaguacggcaacggggucuggaucggccgcaccaagagcaucagcucccggaacggcuucgagaugaucugggaccccaacggguggaccggcaccgacaacaacuucucgaucaagcaggacaucguggggaucaacgagugguccggcuacagcggguccuucgugcagcacccggagcugacgggccuggacugcauccgccccugcuucugggucgagcucauccggggccgccccaaggagaacaccaucuggaccagcggguccagcaucuccuucugcggcgugaacagcgacaccgucgggugguccuggcccgacggcgccgagcugccguucacgaucgacaaguga

SEQ ID NO: 23386 - RNA, 1410 nt, Artificial Sequence; identical to SEQ ID NO: 16318
  derived and/or modified CDS sequence (AUadapt) from InfluenzaA__AEM62828__NA

SEQ ID NO: 23387 - RNA, 1410 nt, Artificial Sequence; identical to SEQ ID NO: 19723
  derived and/or modified CDS sequence (AUadapt) from InfluenzaA__AEM62837__NA

SEQ ID NO: 23388 - RNA, 1410 nt, Artificial Sequence; identical to SEQ ID NO: 16318
  derived and/or modified CDS sequence (AUadapt) from InfluenzaA__AEM62846__NA

SEQ ID NO: 23389 - RNA, 1410 nt, Artificial Sequence
  derived and/or modified CDS sequence (AUadapt) from InfluenzaA__AEM62855__NA
augaaccccaaccagaagaucaucaccaucggcucggugugcaucaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcgugcgcaucggcuccaagggggacguguucgucauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgaggugcccucccccuacaacagccgguucgagagcguggccugguccgcgucggccugccacgacgggaucaacuggcucaccaucggcaucuccggccccgacaacggggccgucgccgugcugaaguacaacggcaucaucaccgacaccaucaagagcuggcgcaacaacauccugcggacgcaggaguccgagugcgcgugcgugaacgggagcugcuucaccgucaugaccgacggcccguccaacggccaggccagcuacaagaucuuccgcaucgagaaggggaagaucgugaaguccguggagaugaacgcccccaacuaccacuacgaggagugcucgugcuaccccgacuccggcgagaucacgugcgucugccgggacaacuggcacgggagcaaccgccccuggguguccuucaaccagaaccucgaguaccagaucggcuacaucugcagcgggaucuucggcgacaacccgcggcccaacgacaagaccggcuccugcgggcccgugagcuccaacggcgccaacggggucaagggcuucucguucaaguacgggaacggcguguggaucggccgcaccaaguccaucagcagccggaacggguucgagaugaucugggaccccaacggcuggaccgggaccgacaacaacuucuccaucaagcaggacaucgugggcaucaacgaguggagcggguacuccggcucguucguccagcacccggagcugacgggccuggacugcauccgccccugcuucuggguggagcucauccgggggcgccccaaggagaacaccaucuggaccuccggcagcuccaucagcuucugcggggucaacuccgacaccgugggcuggagcuggcccgacggcgccgagcugccguucacgaucgacaaguga

SEQ ID NO: 23390 - RNA, 1410 nt, Artificial Sequence
  derived and/or modified CDS sequence (AUadapt) from InfluenzaA__AEM62864__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuucggccccgacaacggggccguggccguccugaaguacaacggcaucaucaccgacaccaucaaguccuggcgcaacaacauccugcggacgcaggagagcgagugcgcgugcgugaacggguccugcuucaccgugaugaccgacggcccgagcgacggccaggccuccuacaagaucuuccgcaucgagaaggggaagaucgucaagagcguggagaugaacgcccccaacuaccacuacgaggagugcuccugcuaccccgacucguccgagaucacgugcgugugccgggacaacuggcacggcagcaaccgccccugggucuccuucaaccagaaccucgaguaccagaucggguacaucugcagcggcaucuucggggacaacccgcggcccaacgacaagaccggcuccugcggccccgugagcuccaacggggccaacggcgugaagggguucagcuucaaguacggcaacggggucuggaucggccgcaccaaguccaucagcucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23391 - RNA, 1410 nt, Artificial Sequence
  derived and/or modified CDS sequence (AUadapt) from InfluenzaA__AEM62872__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacagcucccucugcccggucucgggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagucgguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccguguccuucaacggggccaacggcgugaagggguucagcuucaaguacggcaacggggucuggaucggccgcaccaaguccaucagcucgcggaacggcuucgagaugaucugggaccccaacggguggaccggcaccgacaacaacuucuccaucaagcaggacaucguggggaucaacgaguggagcggcuacuccgggagcuucgugcagcacccggagcugacgggccuggacugcauccgccccugcuucugggucgagcucauccggggccgccccaaggagaacaccaucuggaccuccgggagcuccaucagcuucugcggcgugaacuccgacaccgucggguggagcuggcccgacggcgccgagcugccguucacgaucgacaaguga

SEQ ID NO: 23392 - RNA, 1410 nt, Artificial Sequence; identical to SEQ ID NO: 16318
  derived and/or modified CDS sequence (AUadapt) from InfluenzaA__AEM92310__NA

SEQ ID NO: 23393 - RNA, 1410 nt, Artificial Sequence; identical to SEQ ID NO: 20602
  derived and/or modified CDS sequence (AUadapt) from InfluenzaA__AEM92320__NA

SEQ ID NO: 23394 - RNA, 1410 nt, Artificial Sequence
  derived and/or modified CDS sequence (AUadapt) from InfluenzaA__AEM92340__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcagcccccuggagugccgcaccuucuuccugacccagggcgcccuccugaacgacaagcacuccaacgggaccaucaaggaccggucccccuaccgcacgcugaugucgugcccgaucggcgagguccccucccccuacaacagccgguucgagagcguggccugguccgcgagcgccugccacgacgggaucaacuggcucaccaucggcaucuccggccccgacaacggggccguggccguccugaaguacaacggcaucaucaccgacaccaucaagagcuggcgcaacaacauccugcggacgcaggaguccgagugcgcgugcgugaacgggucgugcuucaccaucaugaccgacggcccguccgacggccaggccagcuacaagaucuuccgcaucgagaaggggaagaucgugaaguccgucgagaugaacgcccccaacuaccacuacgaggagugcagcugcuaccccgacuccagcgagaucacgugcgugugccgggacaacuggcacggcuccaaccgccccugggugucguucaaccagaaccucgaguaccagaucggguacaucugcuccggcaucuucggggacaacccgcggcccaacgacaagaccggcagcugcggccccgucuccagcaacggggccaacggcgugaagggguucuccuucaaguacggcaacgggguguggaucggccgcaccaagagcaucagcucccggaagggcuucgagaugaucugggaccccaacggguggacccgcaccgacaacaacuucucgaucaagcaggacaucgucggcaucaacgagugguccggguacagcggcuccuucgugcagcacccggagcugacggggcuggacugcauccggcccugcuucuggguggagcucauccgcggccggcccaaggagaacaccaucuggaccagcggcuccagcaucuccuucugcggggucaacagcgacaccgugggcugguccuggcccgacggggccgagcugccguucacgaucgacaaguga

SEQ ID NO: 23395 - RNA, 1410 nt, Artificial Sequence; identical to SEQ ID NO: 20602
  derived and/or modified CDS sequence (AUadapt) from InfluenzaA__AEM92350__NA

SEQ ID NO: 23396 - RNA, 1410 nt, Artificial Sequence
  derived and/or modified CDS sequence (AUadapt) from InfluenzaA__AEM92360__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcggagcagagcgucguguccgugaagcuggccggcaacucgucccucugcccggucagcgggugggccaucuacuccaaggacaacagcauccgcaucggcuccaagggcgacguguucgugauccgggagcccuucaucagcugcagcccccuggagugccgcaccuucuuccugacccagggggcccuccugaacgacaagcacuccaacggcaccaucaaggaccggucccccuaccgcacgcugaugucgugcccgaucggggagguccccucccccuacaacagccgguucgagagcguggccugguccgcgagcgccugccacgacggcaucaacuggcucaccaucgggaucuccggccccgacaacggcgccguggccguccugaaguacaacgggaucaucaccgacaccaucaagagcuggcgcaacaacauccugcggacgcaggaguccgagugcgcgugcgugaacggcucgugcuucaccaucaugaccgacgggccguccgacggccaggccagcuacaagaucuuccgcaucgagaagggcaagaucgugaaguccgucgagaugaacgcccccaacuaccacuacgaggagugcagcugcuaccccgacuccagcgagaucacgugcgugugccgggacaacuggcacggguccaaccgccccugggugucguucaaccagaaccucgaguaccagaucggcuacaucugcuccgggaucuucggcgacaacccgcggcccaacgacaagaccgggagcugcggccccgucuccagcaacggcgccaacggggugaagggcuucuccuucaaguacgggaacggcguguggaucgggcgcaccaagagcaucagcucccggaagggcuucgagaugaucugggaccccaacggcuggaccgggaccgacaacaacuucucgaucaagcaggacaucgucggcaucaacgagugguccggguacagcggcuccuucgugcagcacccggagcugacggggcuggacugcauccgccccugcuucuggguggagcucauccggggccgccccaaggagaacaccaucuggaccagcggcuccagcaucuccuucugcggggucaacagcgacaccgugggcugguccuggcccgacggggccgagcugccguucacgaucgacaaguga

SEQ ID NO: 23397 - RNA, 1410 nt, Artificial Sequence; identical to SEQ ID NO: 23394
  derived and/or modified CDS sequence (AUadapt) from InfluenzaA__AEM92370__NA

SEQ ID NO: 23398 - RNA, 1410 nt, Artificial Sequence; identical to SEQ ID NO: 23394
  derived and/or modified CDS sequence (AUadapt) from InfluenzaA__AEM92380__NA

SEQ ID NO: 23399 - RNA, 1410 nt, Artificial Sequence
  derived and/or modified CDS sequence (AUadapt) from InfluenzaA__AEM92399__NA
augaaccccaaccagaagaucaucaccaucggcucggugugcaugaccaucgggauggccaaccugauccuccagaucggcaacaucaucuccaucuggaucagccacuccauccagcuggggaaccagaaccagaucgagacgugcaaccagagcgucaucaccuacgagaacaacaccugggugaaccagaccuacgugaacaucuccaacacgaacuucgccgcgggccagagcgucguguccgugaagcuggccgggaacucgucccucugcccggucagcggcugggccaucuacuccaaggacaacagcauccgcaucggcuccaagggggacguguucgugauccgggagcccuucaucagcugcucgccccuggagugccgcaccuucuuccugacccagggcgcccuccugaacgacaagcacuccaacgggaccaucaaggaccggucccccuaccgcacgcugaugagcugcccgaucggcgagguccccucccccuacaacagccgguucgagagcguggccugguccgcgucggccugccacgacgggaccaacuggcucaccaucggcaucuccggccccgacaacggggccguggccguccugaaguacaacggcaucaucaccgacacgaucaagagcuggcgcaacaacauccugcggacccaggaguccgagugcgcgugcgugaacgggagcugcuucaccgugaugaccgacggcccguccgacggccaggccagcuacaagaucuuccgcaucgagaaggggaagaucgucaaguccguggagaugaacgcccccaacuaccacuacgaggagugcucgugcuaccccgacuccagcgagaucacgugcgugugccgggacaacuggcacggcuccaaccgccccugggucagcuucaaccagaaccucgaguaccagaucggguacaucugcuccggcaucuucggggacaacccgcggcccaacgacaagaccggcagcugcggccccgugcuguccaacggggccaacggcgugaagggguucucguucaaguacggcaacggggucuggaucggccgcaccaaguccaucagcagccggaacggcuucgagaugaucugggaccccaacggguggaccggcacggacaacaacuucuccaucaagcaggacaucguggggaucaacgaguggagcggcuacuccgggucguucgugcagcacccggagcugaccggccucgacugcauccgccccugcuucugggucgagcugauccggggccgccccaaggagaacaccaucuggaccuccgggagcuccaucagcuucugcggcgugaacuccgacacggucggguggagcuggcccgacggcgccgagcugccguucaccaucgacaaguga

SEQ ID NO: 23400 - RNA, 1410 nt, Artificial Sequence; identical to SEQ ID NO: 23399
  derived and/or modified CDS sequence (AUadapt) from InfluenzaA__AEM92409__NA

SEQ ID NO: 23401 - RNA, 1410 nt, Artificial Sequence; identical to SEQ ID NO: 19564
  derived and/or modified CDS sequence (AUadapt) from InfluenzaA__AEM92419__NA
